(12) United States Patent
Brevnova et al.

(10) Patent No.: US 9,206,444 B2
(45) Date of Patent: *Dec. 8, 2015

(54) YEAST EXPRESSING SACCHAROLYTIC ENZYMES FOR CONSOLIDATED BIOPROCESSING USING STARCH AND CELLULOSE

(71) Applicants: Lallemand Hungary Liquidity Management LLC, Budapest (HU); Stellenbosch University, Stellenbosch (ZA)

(72) Inventors: Elena Brevnova, Lebanon, NH (US); John E. McBride, Lyme, NH (US); Erin Wiswall, Danbury, NH (US); Kevin S. Wenger, Hanover, NH (US); Nicky Caiazza, Rancho Santa Fe, CA (US); Heidi Hau, Lebanon, NH (US); Aaron Argyros, White River Junction, VT (US); Frank Agbogbo, Lebanon, NH (US); Charles F. Rice, Hopkinton, NH (US); Trisha Barrett, Bradford, VT (US); John S. Bardsley, Newport, NH (US); Abigail Foster, South Strafford, VT (US); Anne K. Warner, Lebanon, NH (US); Mark Mellon, Grantham, NH (US); Ryan Skinner, White River Junction, VT (US); Indraneel Shikhare, Lebanon, NH (US); Riaan Den Haan, Vierlanden (ZA); Chhayal V. Gandhi, Lebanon, NH (US); Alan Belcher, Nashua, NH (US); Vineet B. Rajgarhia, Courbevoie (FR); Allan C. Froehlich, Lebanon, NH (US); Kristen M. Deleault, Canaan, NH (US); Emily Stonehouse, Lebanon, NH (US); Shital A. Tripathi, Berkley, CA (US); Jennifer Gosselin, Lebanon, NH (US); Yin-Ying Chiu, West Lebanon, NH (US); Haowen Xu, Lebanon, NH (US)

(73) Assignees: Lallemand Hungary Liquidity Management LLC, Budapest (HU); Stellenbosch University, Stellenbosch (ZA)

(*) Notice: Subject to any disclaimer, the term of this patent is extended or adjusted under 35 U.S.C. 154(b) by 0 days.

This patent is subject to a terminal disclaimer.

(21) Appl. No.: 14/178,653
(22) Filed: Feb. 12, 2014
(65) Prior Publication Data
US 2014/0308724 A1 Oct. 16, 2014

Related U.S. Application Data

(63) Continuation of application No. 13/701,652, filed as application No. PCT/US2011/039192 on Jun. 3, 2011.

(60) Provisional application No. 61/420,142, filed on Dec. 6, 2010, provisional application No. 61/351,165, filed on Jun. 3, 2010.

(51) Int. Cl.
C12P 7/06 (2006.01)
C12N 9/24 (2006.01)
(Continued)

(52) U.S. Cl.
CPC .............. *C12P 7/06* (2013.01); *C12N 9/2405* (2013.01); *C12N 9/2437* (2013.01);
(Continued)

(58) Field of Classification Search
None
See application file for complete search history.

(56) References Cited

U.S. PATENT DOCUMENTS

| 5,422,267 A | 6/1995 | Yocum et al. |
| 7,226,776 B2 | 6/2007 | Ingram et al. |

(Continued)

FOREIGN PATENT DOCUMENTS

| CN | 1182451 A | 5/1998 |
| EP | 2 277 989 A1 | 1/2011 |

(Continued)

OTHER PUBLICATIONS

Chica et al. Curr Opin Biotechnol. Aug. 2005;16(4):378-84.*
(Continued)

*Primary Examiner* — Christian Fronda
(74) *Attorney, Agent, or Firm* — Nutter McClennen & Fish LLP

(57) ABSTRACT

The present invention is directed to a yeast strain, or strains, secreting a full suite, or any subset of that full suite, of enzymes to hydrolyze corn starch, corn fiber, lignocellulose, (including enzymes that hydrolyze linkages in cellulose, hemicellulose, and between lignin and carbohydrates) and to utilize pentose sugars (xylose and arabinose). The invention is also directed to the set of proteins that are well expressed in yeast for each category of enzymatic activity. The resulting strain, or strains can be used to hydrolyze starch and cellulose simultaneously. The resulting strain, or strains can be also metabolically engineered to produce less glycerol and uptake acetate. The resulting strain, or strains can also be used to produce ethanol from granular starch without liquefaction. The resulting strain, or strains, can be further used to reduce the amount of external enzyme needed to hydrolyze a biomass feedstock during an Simultaneous Saccharification and Fermentation (SSF) process, or to increase the yield of ethanol during SSF at current saccharolytic enzyme loadings. In addition, multiple enzymes of the present invention can be co-expressed in cells of the invention to provide synergistic digestive action on biomass feedstock. In some aspects, host cells expressing different heterologous saccharolytic enzymes can also be co-cultured together and used to produce ethanol from biomass feedstock.

28 Claims, 119 Drawing Sheets

(51) Int. Cl.
  C12N 15/52  (2006.01)
  C12N 9/42  (2006.01)
  C12N 15/81  (2006.01)
(52) U.S. Cl.
  CPC ............. *C12N 9/2482* (2013.01); *C12N 15/52* (2013.01); *C12N 15/81* (2013.01); *C12Y 302/01004* (2013.01); *C12Y 302/01008* (2013.01); *Y02E 50/17* (2013.01)

(56) References Cited

U.S. PATENT DOCUMENTS

| | | |
|---|---|---|
| 7,666,648 B2 | 2/2010 | Foreman et al. |
| 7,846,712 B2 | 12/2010 | Zhang et al. |
| 2006/0234364 A1 | 10/2006 | Rajgarhia et al. |
| 2006/0257983 A1 | 11/2006 | Bro et al. |
| 2010/0075363 A1 | 3/2010 | McBride et al. |
| 2013/0323822 A1 | 12/2013 | Brevnova et al. |

FOREIGN PATENT DOCUMENTS

| | | |
|---|---|---|
| WO | 96/29397 A1 | 9/1996 |
| WO | WO 03/062430 A1 | 7/2003 |
| WO | WO 2006/009434 A1 | 1/2006 |
| WO | WO 2010/060056 A2 | 5/2010 |
| WO | WO 2010/096562 A2 | 8/2010 |
| WO | 2010/097415 A2 | 9/2010 |
| ZA | 2004/06714 A | 9/2005 |

OTHER PUBLICATIONS van Maris et al. Adv Biochem Eng Biotechnol. 2007;108:179-204.*
Accession Q8TFE5. Jun. 1, 2002.*
Accession Q08806. Nov. 1, 1996.*
Accession Q99034. Nov. 1, 1996.*
Accession Q9P8C9. Oct. 1, 2000.*
Accession Q8A9M2. Jun. 1, 2003.*
Accession Q651U6. Oct. 25, 2004.*
Accession Q651U5. Oct. 25, 2004.*
Accession A1A067. Jan. 23, 2007.*
Accession No. XM_742804.1, NCBI Database, accessed at www.ncbi.nlm.nih.gov/nuccore/xm_742804.1, accessed on Apr. 25, 2014.
Sato, S., et al., "Expression analysis of extracellular proteins from *Phanerochaete chrysosporium* grown on different liquid and solid substrates," *Microbiology* 153:3023-3033, SGM, Great Britain (2007).
Valášková, V. and Baldrian, P., "Estimation of bound and free fractions of lignocellulose-degrading enzymes of wood-rotting fungi *Pleurotus ostreatus, Trametes versicolor* and *Piptoporus betulinus*," *Research in Microbiology* 157:119-124, Elsevier SAS, France (2006).
Ansell, R., et al., "The two isoenzymes for yeast NAD+-dependent glycerol 3-phosphate dehydrogenase encoded by *GDP1* and *GDP2* have distinct roles in osmoadaptation and redox regulation," *The EMBO Journal* 16(9):2719-2187, Nature Publishing Group, England (1997).
Bowie, J.U., et al., "Deciphering the Message in Protein Sequences: Tolerance to Amino Acid Substitutions," *Science* 247:1306-1310, Science, United States (1990).
Bro, C., et al., "In silico aided metabolic engineering of *Saccharomyces cerevisiae* for improved bioethanol production," *Metabolic Engineering* 8:102-111, Elsevier Inc., United States (2006).
Brutlag, D.L., et al., "Improved Sensitivity of Biological Sequence Database Searches," *Comp. App. Biosci.* 6:237-245, Oxford University Press, United Kingdom (1990).
Burke, D.T., et al., "Cloning of Large Segments of Exogenous DNA into Yeast by Means of Artificial Chromosome Vectors," *Science* 236:806-812, American Association for the Advancement of Science, United States (1987).

Casey, G.P., et al., "A Convenient Dominant Selection Marker for Gene Transfer in Industrial Strains of *Saccharomyces cerevisiae*: SMRI Encoded Resistance to the Herbicide Sulfometuron Methyl," *J. Inst. Brew* 94(2):93-97 (1988).
Chilebowicz-Śledziewska, E. and Śledziewski, A.Z., "Construction of multicopy yeast plasmids with regulated centromere function," *Gene* 39:25-31, Elsevier Science Publishers, Netherlands (1985).
Cunningham, B.C. and Wells, J.A., "High-Resolution Epitope Mapping of hGH-Receptor Interactions by Alanine-Scanning Mutagenesis," *Science* 244:1081-1085, American Association for the Advancement of Science, United States (1989).
Davies, G. & Henrissat, B., "Structures and Mechanisms of Glycosyl Hydrolases," *Structure* 3:853-859, Current Biology Ltd., United States (1995).
Demain, A. L., et al., "Cellulase, Clostridia, and Ethanol," *Microbial. Mol. Biol. Rev.* 69:124-154, American Society for Microbiolgy, United States (2005).
Den Haan, R., et al., "Hydrolysis and fermentation of amorphous cellulose by recombinant *Saccharomyces cerevisiae*," *Metabolic Engineering* 9:87-94, Academic Press, United States (2007).
Fujita, Y. et al., "Synergistic Saccharification, and Direct Fermentation to Ethanol, of Amorphous Cellulose by Use of an Engineered Yeast Strain Codisplaying Three Types of Cellulolytic Enzyme," *Applied and Environmental Microbiology* 70:1207-1212, American Society for Microbiology, United States (2004).
Guo, Z., et al., "Minimization of glycerol synthesis in industrial ethanol yeast without influencing its fermentation performance," *Metabolic Engineering* 13(1):49-59, Elsevier, Inc., United States (Jan. 2011).
Gusakov, A.V., et al., "Design of Highly Efficient Cellulase Mixtures for Enzymatic Hydrolysis of Cellulose," *Biotechnology and Bioengineering* 97(5):1028-1038, Wiley Periodicals, Inc., United States (2007).
Hahn-Hägerdal, B., et al., "Metabolic Engineering of *Saccharomyces cerevisiae* for Xylose Utilization," *Adv. in Biochem. Eng. Biotechnol.* 73:53-84, Springer-Verlag, Germany (2001).
Henrissat, B., et al., "Conserved Catalytic Machinery and the Prediction of a Common Fold for Several Families of Glycosyl Hyydrolases," *Proc. Natl. Acad. Sci.* 92: 7090-7094, National Academy of Sciences, United States (1995).
Herpoël-Gimbert, I., et al., "Comparative secretome analyses of two *Trichoderma reesei* RUT-C30 and CL847 hypersecretory strains," *Biotechnology for Biofuels* 1(18):1-12, BioMed Central Ltd., England (2008).
Higgins, D.G. and Sharp, P.M., "Fast and sensitive multiple sequence alignments on a microcomputer," *CABIOS*, 5:151-153, Oxford University Press, UK (1989).
Jeppsson M., et al. "Reduced Oxidative Pentose Phosphate Pathway Flux in Recombinant Xylose-Utilizing *Saccharomyces cerevisiae* Strains Improves the Ethanol Yield from Xylose," *Appl. Environ. Microbiol.* 68(4):1604-1609, American Society for Microbiology, Washington, United States (2002).
Karhumaa, K., et al., "Comparison of the zylose reductase-xylitol dehydrogenase and the xylose isomerase pathways for xylose fermentation by recombinant *Saccharomyces cerevisiae*," *Microbiol Cell Factories* 6(5):1-10, BioMed Central, England (2007).
Krzywinski, M., et al., "Integrated and Sequence-Ordered BAC- and YAC-Based Physical Maps for the Rat Genome," *Genome Research* 14(4):766-779, Cold Spring Harbor Laboratory Press, United States (2004).
La Grange, D.C., et al., "Expression of a *Trichoderma reesei* β-Xylanase Gene (*XYN2*) in *Saccharomyces cerevisiae*," *Appl. Environ. Microbiol.*, 62:1036-1044, American Society for Microbiology, United States (1996).
Leal, T.F. and De Sá-Nogueira, I., "Purification, characterization and functional analysis of an endo-arabinose (AbnA) from *Bacillus subtilis*," *FEMS Microbiol. Let.* 241:41-48, Elsevier, B.V., Netherlands (2004).
Lidén, G., et al., "A Glycerol-3-Phosphate Dehydrogenase-Deficient Mutant of *Saccharomyces cerevisiae* Expressing the Heterologous *XYL1* Gene," *Appl. Environ. Microbiol.* 62(10):3894-3896, American Society for Microbiology, United States (1996).

(56) References Cited

OTHER PUBLICATIONS

Lynd, L.R., et al., "Microbial Cellulose Utilization: Fundamentals and Biotechnology," *Microbiology and Molecular Biology Reviews* 66(3):506-577, American Society for Microbiology, United States (2002).
Martinez, D., et al., "Genome sequencing and analysis of the biomass-degrading fungus *Trichoderma reesei* (syn. *Hypocrea jecorina*)," *Nature Biotechnology* 26(5):553-560, Nature America Publishing, United States (2008).
McBride, J.E., et al., "Utilization of Cellobiose by Recombinant β-Glucosidase-Expressing Strains of *Saccharomyces cerevisiae*: Characterization and Evaluation of the Sufficiency of Expression," *Enzyme and Microbial Technology* 37:93-101, Elsevier, Holland (2005).
Medina, V.G., et al., "Elimination of Glycerol Production in Anaerobic Cultures of a *Saccharomyces cerevisiae* Strain Engineered to Use Acetic Acid as an Electron Acceptor," *Applied and Environmental Microbiology* 76(1):190-195, American Society for Microbiology, United States (Jan. 2010).
Mota, L.J., et al., "Control of the Arabinose Regulation in *Bacillus subtilis* by AraR In Vivo: Crucial Roles of Operators, Cooperativity, and DNA Looping," *J. Bacteriol.* 183(14):4190-4201, American Society for Microbiology, United States (2001).
Mota, L.J., et al., "Mode of action of AraR, the key regulator of L-Arabinose metabolism in *Bacillus subtilis*," *Molec. Microbiol.* 33(3):476-489, Blackwell Science Ltd., England (1999).
Nakamura, Y., et al., "Codon Usage Tabulated from International DNA Sequence Databases: Status for the Year 2000," *Nucl. Acids Res.* 28:292, Oxford University Press, United Kingdom (2000).
Oldenburg, K.R., et al., "Recombination-mediated PCR-directed plasmid construction in vivo in yeast," *Nucleic Acids Research* 25(2):451-452, Oxford University Press, England (1997).
Páhlman, A-K., et al., "The Yeast Glycerol 3-Phosphatases Gpp1p and Gpp2p are Required for Glycerol Biosynthesis and Differentially Involved in the Cellular Response to Osmotic, Anaerobic, and Oxidative Stress," *J. Biol. Chem.* 276(5):3555-3563, American Society for Biochemistry and Molecular Biology, United States (2006).
Rosgaard, L., et al., "Efficiency of New Fungal Cellulase Systems in Boosting Enzymatic Degradation of Barley Straw Lignocellulose," *Biotechnol. Prog.* 22:493-498, American Chemical Society and Anerican Institute of Chemical Engineers, United States (2006).
Ryabova, O., et al., "A novel family of hemicellulolytic α-glucuronidase," *FEBS Letters* 583:1457-1462, Elsevier B.V., Netherlands (May 2009).
Saulnier, L., et al., "Cell wall polysaccharide interactions in maize bran," *Carbohydrate Polymers* 26:279-287, Elsevier Science Limited, Great Britain (1995).
Schleif, R., "Regulation of the L-arabinose operon of *Escherichia coli,"* *Trends in Genetics* 16(12):559-565, Elsevier Science, Ltd., England (2000).
Shao, Z., et al., "DNA assembler, an in vivo genetic method for rapid construction of biochemical pathways," *Nucleic Acids Research* 37(2):1-10, Oxford University Press, England (2008).
Smith, D.R., et al., "Amplification of large artificial chromosomes," *Proc. Natl. Acad. Sci. USA* 87:8242-8246, National Academy of Sciences, United States (1990).
Špániková, S. and Biely, P., "Glucuronoyl esterase—Novel carbohydrates esterase produced by Schizophyllum commune," *FEBS Letters* 580:4597-4601, Elsevier B.V., Netherlands (2006).
Spencer, F. and Smichen, G., "Transfer of YAC Clones to New Yeast Hosts," in *Methods in Molecular Biology: YAC Protocols*, vol. 54, Markie, D., ed., Chapter 22, pp. 239-252, Humana Press Inc., Totowa, NJ, United States (1996).
Stairs, C.W., et al., "Eukaryotic pyruvate formate lyase and its activating enzyme were acquired laterally from a firmicute," *Molecular Biology and Evolution*, Advanced Access published Feb. 3, 2011, 42 pages, Oxford University Press, England (Feb. 2011).
Sun, Y. and Cheng, J., "Hydrolysis of Lignocellulosic Materials for Ethanol Production: A Review," *Bioresource Technol.* 83:1-11, Elsevier, Holland (2002).

Tamás, MJ., et al., "Fpd1p controls the accumulation and release of the compatible solute glycerol in yeast osmoregulation," *Molecular Microbiology* 31(4):1087-1104, Blackwell Science Ltd, England (1999).
Van Rensburg, P., et al., "Engineering Yeast for Efficient Cellulose Degradation," *Yeast* 14:67-76, Jon Wiley & Sons, Ltd., United States (1998).
Van Rooyen, R., et al., "Construction of Cellobiose-Growing and Fermenting *Saccharomyces cerevisiae* Strains," *J Biotechnol.* 120:284-295, Elsevier, Holland (2005).
Van Zyl, W.H, et al., "Consolidated Bioprocessing for Bioethanol Production using *Saccharomyces cereviside,*" *Advances in Biochemical Engineering Biotechnology* 108:205-235, Springer-Verlag, Germany (2007).
Waks, Z. and Silver, P. A., "Engineering a Synthetic Dual-Organism System for Hydrogen Production," *Appl. Env. Microbiol.* 75(7):1867-1875, American Society for Microbiology, United States (Apr. 2009).
Watanabe, S., et al., "Cloning, Expression, and Characterization of Bacterial L-Arabinose 1-Dehydrogenase Involved in an Alternative Pathway of L-Arabinose Metabolism," *J Biol. Chem.* 281(5):2612-2623, American Society for Biochemistry and Molecular Biology, United States (2006).
Zhou, J., et al., "Optimization of cellulase mixture for efficient hydrolysis of steam-exploded corn stover by statistically designed experiments," *Bioresource Technology* 100:819-825, Elsevier Ltd., England (Jan. 2009).
"Backtranslation tool citations" accessed at www.entelechon.com/2008/10/backtranslation-tool/ on Apr. 23, 2013.
"Codon Usage Database" accessed at http://www.kazusa.or.jp/codon/ on Apr. 23, 2013.
Sá-Nogueira, I., et al., "The *Bacillus subtilis* L-arabinose (*ara*) operon: nucleotide sequence, genetic organization and expression," *Microbiology* 143:957-969, Society for General Microbiology, Great Britain (1997).
Margolles-Clark, E., et al., "Three α-galactosidase genes of *Trichoderma reesei* cloned by expression in yeast," *Eur. J Biochem.* 240:104-111, FEBS, Netherlands (1996).
International Search Report for International Application No. PCT/US2011/39192, US Patent Office, United States, mailed on Feb. 3, 2012.
UNIPROT Accession No. Q4WCM9_ASPFU, Nierman, W.C., et al., created (Jul. 5, 2005).
Accession No. XP_747897.1, NCBI Database, accessed at www.ncbi.nlm.gov/protein/XP_747897.1, accessed on May 1, 2013.
Accession No. XP_001257357, NCBI Database, accessed at www.ncbi.nlm.gov/protein/XP_001257357, accessed on May 1, 2013.
Accession No. XP_001270378, NCBI Database, accessed at www.ncbi.nlm.gov/protein/XP_001270378, accessed on May 1, 2013.
Accession No. XP_001217291, NCBI Database, accessed at www.ncbi.nlm.gov/protein/XP_001217291, accessed on May 1, 2013.
Accession No. XP_002152969, NCBI Database, accessed at www.ncbi.nlm.gov/protein/XP_002152969, accessed on May 1, 2013.
Accession No. XP_001229968, NCBI Database, accessed at www.ncbi.nlm.gov/protein/XP_001229968, accessed on May 1, 2013.
Accession No. XP_956431, NCBI Database, accessed at www.ncbi.nlm.gov/protein/XP_956431, accessed on May 1, 2013.
Accession No. BAA22589, NCBI Database, accessed at www.ncbi.nlm.gov/protein/BAA22589, accessed on May 1, 2013.
Accession No. AAE25067, NCBI Database, accessed at www.ncbi.nlm.gov/protein/AAE25067, accessed on May 1, 2013.
Accession No. AAG09047, NCBI Database, accessed at www.ncbi.nlm.gov/protein/AAG09047, accessed on May 1, 2013.
Accession No. IDYM_A, NCBI Database, accessed at www.ncbi.nlm.gov/protein/IDYM_A, accessed on May 1, 2013.
Accession No. XP_001935476.1, NCBI Database, accessed at www.ncbi.nlm.gov/protein/XP_001935476.1, accessed on May 1, 2013.
Accession No. XP_370166.2, NCBI Database, accessed at www.ncbi.nlm.gov/protein/XP_370166.2?report=genpept, accessed on May 1, 2013.
Accession No. XP_388429.1, NCBI Database, accessed at www.ncbi.nlm.gov/protein/XP_388429.1, accessed on May 1, 2013.

(56) References Cited

OTHER PUBLICATIONS

Accession No. BAF75943, NCBI Database, accessed at www.ncbi.nlm.gov/protein/BAF75943.1, accessed on May 1, 2013.
Accession No. BAB62317, NCBI Database, accessed at www.ncbi.nlm.gov/protein/BAB62317.1, accessed on May 1, 2013.
Accession No. CAC12958, NCBI Database, accessed at www.ncbi.nlm.gov/protein/CAC12958.1, accessed on May 1, 2013.
Accession No. AAD04193, NCBI Database, accessed at www.ncbi.nlm.gov/protein/AAD04193.1, accessed on May 1, 2013.
Accession No. BAD67544, NCBI Database, accessed at www.ncbi.nlm.gov/protein/BAD67544.1, accessed on May 1, 2013.
Accession No. XP_001220409, NCBI Database, accessed at www.ncbi.nlm.gov/protein/XP_001220409.1, accessed on May 1, 2013.
Accession No. XP_001397982, NCBI Database, accessed at www.ncbi.nlm.gov/protein/XP_001397982.1, accessed on May 1, 2013.
Accession No. ABY28340, NCBI Database, accessed at www.ncbi.nlm.gov/protein/ABY28340.1, accessed on May 1, 2013.
Accession No. AAU12276, NCBI Database, accessed at www.ncbi.nlm.gov/protein/AAU12276, accessed on May 1, 2013.
Accession No. AAM77710, NCBI Database, accessed at www.ncbi.nlm.gov/protein/AAM77710, accessed on May 1, 2013.
Accession No. XP_001261563, NCBI Database, accessed at www.ncbi.nlm.gov/protein/XP_001261563.1, accessed on May 1, 2013.
Accession No. AAM77701, NCBI Database, accessed at www.ncbi.nlm.gov/protein/AAM77701, accessed on May 1, 2013.
Accession No. EAQ86340, NCBI Database, accessed at www.ncbi.nlm.gov/protein/EAQ86340, accessed on May 1, 2013.
Accession No. CAF31975, NCBI Database, accessed at www.ncbi.nlm.gov/protein/CAF31975, accessed on May 1, 2013.
Accession No. CAG27577, NCBI Database, accessed at www.ncbi.nlm.gov/protein/CAG27577, accessed on May 1, 2013.
Accession No. XP_001267517, NCBI Database, accessed at www.ncbi.nlm.gov/protein/XP_001267517, accessed on May 1, 2013.
Accession No. ACE10231, NCBI Database, accessed at www.ncbi.nlm.gov/protein/ACE10231, accessed on May 1, 2013.
Accession No. ACH15008, NCBI Database, accessed at www.ncbi.nlm.gov/protein/ACH15008, accessed on May 1, 2013.
Accession No. XP_001226436, NCBI Database, accessed at www.ncbi.nlm.gov/protein/XP_001226436, accessed on May 1, 2013.
Accession No. ACE10216, NCBI Database, accessed at www.ncbi.nlm.gov/protein/ACE10216, accessed on May 1, 2013.
Accession No. CAB42307, NCBI Database, accessed at www.ncbi.nlm.gov/protein/CAB42307, accessed on May 1, 2013.
Accession No. CAH03187, NCBI Database, accessed at www.ncbi.nlm.gov/protein/CAH03187, accessed on May 1, 2013.
Accession No. AAQ38151, NCBI Database, accessed at www.ncbi.nlm.gov/protein/AAQ38151, accessed on May 1, 2013.
Accession No. EDJ97375, NCBI Database, accessed at www.ncbi.nlm.gov/protein/EDJ97375.1?report=genpept, accessed on May 1, 2013.
Accession No. EAQ84577, NCBI Database, accessed at www.ncbi.nlm.gov/protein/EAQ84577, accessed on May 1, 2013.
Accession No. 1DYS_B, NCBI Database, accessed at www.ncbi.nlm.gov/protein/1DYS_B, accessed on May 1, 2013.
Accession No. XP_957415, NCBI Database, accessed at www.ncbi.nlm.gov/protein/XP_957415.1, accessed on May 1, 2013.
Accession No. AAP57752, NCBI Database, accessed at www.ncbi.nlm.gov/protein/AAP57752, accessed on May 1, 2013.
Accession No. AAK77227, NCBI Database, accessed at www.ncbi.nlm.gov/protein/AAK77227 accessed on May 1, 2013.
Accession No. BAA29031, NCBI Database, accessed at www.ncbi.nlm.gov/protein/BAA29031, accessed on May 1, 2013.
Accession No. XP_001261776, NCBI Database, accessed at www.ncbi.nlm.gov/protein/XP_001261776, accessed on May 1, 2013.
Accession No. CAD48749, NCBI Database, accessed at www.ncbi.nlm.gov/protein/CAD48749, accessed on May 1, 2013.
Accession No. ABK59833, NCBI Database, accessed at www.ncbi.nlm.gov/protein/ABK59833, accessed on May 1, 2013.
Accession No. AAQ38147, NCBI Database, accessed at www.ncbi.nlm.gov/protein/AAQ38147, accessed on May 1, 2013.
Accession No. BAE71410, NCBI Database, accessed at www.ncbi.nlm.gov/protein/BAE71410, accessed on May 1, 2013.
Accession No. CAA73902, NCBI Database, accessed at www.ncbi.nlm.gov/protein/CAA73902, accessed on May 1, 2013.
Accession No. AAC67554, NCBI Database, accessed at www.ncbi.nlm.gov/protein/AAC67554, accessed on May 1, 2013.
Accession No. BAC75546, NCBI Database, accessed at www.ncbi.nlm.gov/protein/BAC75546, accessed on May 1, 2013.
Accession No. XP_001940956, NCBI Database, accessed at www.ncbi.nlm.gov/protein/XP_001940956, accessed on May 1, 2013.
Accession No. Q9UUZ3, NCBI Database, accessed at www.ncbi.nlm.gov/protein/Q9UUZ3, accessed on May 1, 2013.
Accession No. BAA29029, NCBI Database, accessed at www.ncbi.nlm.gov/protein/BAA29029, accessed on May 1, 2013.
Accession No. XP_001258000, NCBI Database, accessed at www.ncbi.nlm.gov/protein/XP_001258000, accessed on May 1, 2013.
Accession No. CAA92949, NCBI Database, accessed at www.ncbi.nlm.gov/protein/CAA92949, accessed on May 1, 2013.
Accession No. CAC38119, NCBI Database, accessed at www.ncbi.nlm.gov/protein/CAC38119, accessed on May 1, 2013.
Accession No. AAL33576, NCBI Database, accessed at www.ncbi.nlm.gov/protein/AAL33576, accessed on May 1, 2013.
Accession No. XP_001395572, NCBI Database, accessed at www.ncbi.nlm.gov/protein/XP_001395572, accessed on May 1, 2013.
Accession No. Q99034, NCBI Database, accessed at www.ncbi.nlm.gov/protein/Q99034, accessed on May 1, 2013.
Accession No. XP_001262186, NCBI Database, accessed at www.ncbi.nlm.gov/protein/XP_001262186, accessed on May 1, 2013.
Accession No. AAP57750, NCBI Database, accessed at www.ncbi.nlm.gov/protein/AAP57750, accessed on May 1, 2013.
Accession No. XP_001223478, NCBI Database, accessed at www.ncbi.nlm.gov/protein/XP_001223478, accessed on May 1, 2013.
Accession No. XP_001389998, NCBI Database, accessed at www.ncbi.nlm.gov/protein/XP_001389998, accessed on May 1, 2013.
Accession No. ACH57439, NCBI Database, accessed at www.ncbi.nlm.gov/protein/ACH57439, accessed on May 1, 2013.
Accession No. XP_001257521, NCBI Database, accessed at www.ncbi.nlm.gov/protein/XP_001257521, accessed on May 1, 2013.
Accession No. EED19018, NCBI Database, accessed at www.ncbi.nlm.gov/protein/EED19018, accessed on May 1, 2013.
Accession No. AAP57751, NCBI Database, accessed at www.ncbi.nlm.gov/protein/AAP57751, accessed on May 1, 2013.
Accession No. XP_001228455, NCBI Database, accessed at www.ncbi.nlm.gov/protein/XP_001228455, accessed on May 1, 2013.
Accession No. XP_365869, NCBI Database, accessed at www.ncbi.nlm.gov/protein/XP_365869.1?report-genpept, accessed on May 1, 2013.
Accession No. AAP57749, NCBI Database, accessed at www.ncbi.nlm.gov/protein/AAP57749, accessed on May 1, 2013.
Accession No. XP_001226041, NCBI Database, accessed at www.ncbi.nlm,gov/protein/XP_001226041, accessed on May 1, 2013.
Accession No. XP_751313, NCBI Database, accessed at www.ncbi.nlm.gov/protein/XP_751313, accessed on May 1, 2013.
Accession No. BAB39482, NCBI Database, accessed at www.ncbi.nlm.gov/protein/BAB39482, accessed on May 1, 2013.
Accession No. BAC66697, NCBI Database, accessed at www.ncbi.nlm.gov/protein/BAC66697, accessed on May 1, 2013.
Accession No. AAS48881, NCBI Database, accessed at www.ncbi.nlm.gov/protein/AAS48881, accessed on May 1, 2013.
Accession No. AAZ08315, NCBI Database, accessed at www.ncbi.nlm.gov/protein/AAZ08315, accessed on May 1, 2013.
Accession No. XP_001393337, NCBI Database, accessed at www.ncbi.nlm.gov/protein/XP_001393337, accessed on May 1, 2013.
Accession No. XP_001211092, NCBI Database, accessed at www.ncbi.nlm.gov/protein/XP_001211092, accessed on May 1, 2013.
Accession No. EED17739, NCBI Database, accessed at www.ncbi.nlm.gov/protein/EED17739, accessed on May 1, 2013.
Accession No. XP_001228412, NCBI Database, accessed at www.ncbi.nlm.gov/protein/XP_001228412, accessed on May 1, 2013.
Accession No. NP_821732.1, NCBI Database, accessed at www.ncbi.nlm.gov/protein/NP_821732.1, accessed on May 1, 2013.
Accession No. NP_823029.1, NCBI Database, accessed at www.ncbi.nlm.gov/protein/NP_823029.1, accessed on May 1, 2013.

(56) References Cited

OTHER PUBLICATIONS

Accession No. NP_823031.1, NCBI Database, accessed at www.ncbi.nlm.nih.gov/protein/NP_823031.1, accessed on May 1, 2013.
Accession No. NP_821730.1, NCBI Database, accessed at www.ncbi.nlm.nih.gov/protein/NP_821730.1, accessed on May 1, 2013.
Accession No. NP_823030.1, NCBI Database, accessed at www.ncbi.nlm.nih.gov/protein/NP_823030.1, accessed on May 1, 2013.
Accession No. NP_823032.1, NCBI Database, accessed at www.ncbi.nlm.nih.gov/protein/NP_823032.1, accessed on May 1, 2013.
Accession No. NP_823744.1, NCBI Database, accessed at www.ncbi.nlm.nih.gov/protein/NP_823744.1, accessed on May 1, 2013.
Accession No. NP_826394.1, NCBI Database, accessed at www.ncbi.nlm.nih.gov/protein/NP_826394.1, accessed on May 1, 2013.
Accession No. NP_828072.1, NCBI Database, accessed at www.ncbi.nlm.nih.gov/protein/NP_828072.1, accessed on May 1, 2013.
Accession No. NP_823272.1, NCBI Database, accessed at www.ncbi.nlm.nih.gov/protein/NP_823272.1, accessed on May 1, 2013.
Accession No. NP_826161.1, NCBI Database, accessed at www.ncbi.nlm.nih.gov/protein/NP_826161.1, accessed on May 1, 2013.
Accession No. NP_827548.1, NCBI Database, accessed at www.ncbi.nlm.nih.gov/protein/NP_827548.1, accessed on May 1, 2013.
Accession No. NP_827557.1, NCBI Database, accessed at www.ncbi.nlm.nih.gov/protein/NP_827557.1, accessed on May 1, 2013.
Accession No. NP_822628.1, NCBI Database, accessed at www.ncbi.nlm.nih.gov/protein/NP_822628.1, accessed on May 1, 2013.
Accession No. NP_823285.1, NCBI Database, accessed at www.ncbi.nlm.nih.gov/protein/NP_823285.1, accessed on May 1, 2013.
Accession No. NP_826159.1, NCBI Database, accessed at www.ncbi.nlm.nih.gov/protein/NP_826159.1, accessed on May 1, 2013.
Accession No. NP_827745.1, NCBI Database, accessed at www.ncbi.nlm.nih.gov/protein/NP_827745.1, accessed on May 1, 2013.
Accession No. NP_822977.1, NCBI Database, accessed at www.ncbi.nlm.nih.gov/protein/NP_822977.1, accessed on May 1, 2013.
Accession No. NP_826430.1, NCBI Database, accessed at www.ncbi.nlm.nih.gov/protein/NP_826430.1, accessed on May 1, 2013.
Accession No. NP_826775.1, NCBI Database, accessed at www.ncbi.nlm.nih.gov/protein/NP_826775.1, accessed on May 1, 2013.
Accession No. NP_822477.1, NCBI Database, accessed at www.ncbi.nlm.nih.gov/protein/NP_822477.1, accessed on May 1, 2013.
Accession No. NP_822632.1, NCBI Database, accessed at www.ncbi.nlm.nih.gov/protein/NP_822632.1, accessed on May 1, 2013.
Accession No. NP_822218.1, NCBI Database, accessed at www.ncbi.nlm.nih.gov/protein/NP_822218.1, accessed on May 1, 2013.
Accession No. NP_822290.1, NCBI Database, accessed at www.ncbi.nlm.nih.gov/protein/NP_822290.1, accessed on May 1, 2013.
Accession No. NP_826920.1, NCBI Database, accessed at www.ncbi.nlm.nih.gov/protein/NP_826920.1, accessed on May 1, 2013.
Accession No. BAC74043.1, NCBI Database, accessed at www.ncbi.nlm.nih.gov/protein/BAC74043.1, accessed on May 1, 2013.
Accession No. BAC74467.1, NCBI Database, accessed at www.ncbi.nlm.nih.gov/protein/BAC74467.1, accessed on May 1, 2013.
Accession No. BAC68338.1, NCBI Database, accessed at www.ncbi.nlm.nih.gov/protein/BAC68338.1, accessed on May 1, 2013.
Accession No. BAC68787.1, NCBI Database, accessed at www.ncbi.nlm.nih.gov/protein/BAC68787.1, accessed on May 1, 2013.
Accession No. BAC69185.1, NCBI Database, accessed at www.ncbi.nlm.nih.gov/protein/BAC69185.1, accessed on May 1, 2013.
Accession No. YP_528462.1, NCBI Database, accessed at www.ncbi.nlm.nih.gov/protein/YP_528462.1, accessed on May 1, 2013.
Accession No. YP_528465.1, NCBI Database, accessed at www.ncbi.nlm.nih.gov/protein/YP_528465.1, accessed on May 1, 2013.
Accession No. YP_528492.1, NCBI Database, accessed at www.ncbi.nlm.nih.gov/protein/YP_528492.1, accessed on May 1, 2013.
Accession No. ABD82260.1, NCBI Database, accessed at www.ncbi.nlm.nih.gov/protein/ABD82260.1, accessed on May 1, 2013.
Accession No. ABD82186.1, NCBI Database, accessed at www.ncbi.nlm.nih.gov/protein/ABD82186.1, accessed on May 1, 2013.
Accession No. ABD80834.1, NCBI Database, accessed at www.ncbi.nlm.nih.gov/protein/ABD80834.1, accessed on May 1, 2013.
Accession No. ABD81754.1, NCBI Database, accessed at www.ncbi.nlm.nih.gov/protein/ABD81754.1, accessed on May 1, 2013.
Accession No. AD79898.1, NCBI Database, accessed at www.ncbi.nlm.nih.gov/protein/ABD79898.1, accessed on May 1, 2013.
Accession No. ABD81757.1, NCBI Database, accessed at www.ncbi.nlm.nih.gov/protein/ABD81757.1, accessed on May 1, 2013.
Accession No. ABD79509.1, NCBI Database, accessed at www.ncbi.nlm.nih.gov/protein/ABD79509.1, accessed on May 1, 2013.
Accession No. ABD82858.1, NCBI Database, accessed at www.ncbi.nlm.nih.gov/protein/ABD82858.1, accessed on May 1, 2013.
Accession No. ABD80656.1, NCBI Database, accessed at www.ncbi.nlm.nih.gov/protein/ABD80656.1, accessed on May 1, 2013.
Accession No. ABD80580.1, NCBI Database, accessed at www.ncbi.nlm.nih.gov/protein/ABD80580.1, accessed on May 1, 2013.
Accession No. ABD80168.1, NCBI Database, accessed at www.ncbi.nlm.nih.gov/protein/ABD80168.1, accessed on May 1, 2013.
Accession No. YP_525985.1, NCBI Database, accessed at www.ncbi.nlm.nih.gov/protein/YP_525985.1, accessed on May 1, 2013.
Accession No. YP_525645.1, NCBI Database, accessed at www.ncbi.nlm.nih.gov/protein/YP_525645.1, accessed on May 1, 2013.
Accession No. CAB13755.1, NCBI Database, accessed at www.ncbi.nlm.nih.gov/protein/CAB13755.1, accessed on May 1, 2013.
Accession No. CAB13696.2, NCBI Database, accessed at www.ncbi.nlm.nih.gov/protein/CAB13696.2, accessed on May 1, 2013.
Accession No. CAB13698.1, NCBI Database, accessed at www.ncbi.nlm.nih.gov/protein/CAB13698.1, accessed on May 1, 2013.
Accession No. CAB13699.1, NCBI Database, accessed at www.ncbi.nlm.nih.gov/protein/CAB13699.1, accessed on May 1, 2013.
Accession No. CAB13776.1, NCBI Database, accessed at www.ncbi.nlm.nih.gov/protein/CAB13776.1, accessed on May 1, 2013.
Accession No. CAB13642.2, NCBI Database, accessed at www.ncbi.nlm.nih.gov/protein/CAB13642.2, accessed on May 1, 2013.
Accession No. YP_001560459.1, NCBI Database, accessed at www.ncbi.nlm.nih.gov/protein/YP_001560459.1, accessed on May 1, 2013.
Accession No. YP_001560460.1, NCBI Database, accessed at www.ncbi.nlm.nih.gov/protein/YP_001560460.1, accessed on May 1, 2013.
Accession No. YP_001559165.1, NCBI Database, accessed at www.ncbi.nlm.nih.gov/protein/YP_001559165.1, accessed on May 1, 2013.
Accession No. YP_001560295.1, NCBI Database, accessed at www.ncbi.nlm.nih.gov/protein/YP_001560295.1, accessed on May 1, 2013.
Accession No. YP_001558280.1, NCBI Database, accessed at www.ncbi.nlm.nih.gov/protein/YP_001558280.1, accessed on May 1, 2013.
Accession No. YP_001560421.1, NCBI Database, accessed at www.ncbi.nlm.nih.gov/protein/YP_001560421.1, accessed on May 1, 2013.
Accession No. YP_001558242.1, NCBI Database, accessed at www.ncbi.nlm.nih.gov/protein/YP_001558242.1, accessed on May 1, 2013.
Accession No. YP_001558623.1, NCBI Database, accessed at www.ncbi.nlm.nih.gov/protein/YP_001558623.1, accessed on May 1, 2013.
Accession No. YP_001557750.1, NCBI Database, accessed at www.ncbi.nlm.nih.gov/protein/YP_001557750.1, accessed on May 1, 2013.
Accession No. YP_001559210.1, NCBI Database, accessed at www.ncbi.nlm.nih.gov/protein/YP_001559210.1, accessed on May 1, 2013.
Accession No. YP_001559213.1, NCBI Database, accessed at www.ncbi.nlm.nih.gov/protein/YP_001559213.1, accessed on May 1, 2013.
Accession No. YP_001560300.1, NCBI Database, accessed at www.ncbi.nlm.nih.gov/protein/YP_001560300.1, accessed on May 1, 2013.
Accession No. YP_001557317.1, NCBI Database, accessed at www.ncbi.nlm.nih.gov/protein/YP_001557317.1, accessed on May 1, 2013.
Accession No. YP_001558000.1, NCBI Database, accessed at www.ncbi.nlm.nih.gov/protein/YP_001558000.1, accessed on May 1, 2013.
Accession No. YP_001558286.1, NCBI Database, accessed at www.ncbi.nlm.nih.gov/protein/YP_001558286.1, accessed on May 1, 2013.
Accession No. YP_001558190.1, NCBI Database, accessed at www.ncbi.nlm.nih.gov/protein/YP_001558190.1, accessed on May 1, 2013.
Accession No. YP_001559233.1, NCBI Database, accessed at www.ncbi.nlm.nih.gov/protein/YP_001559233.1, accessed on May 1, 2013.
Accession No. YP_001559376.1, NCBI Database, accessed at www.ncbi.nlm.nih.gov/protein/YP_001559376.1, accessed on May 1, 2013.
Accession No. YP_001559043.1, NCBI Database, accessed at www.ncbi.nlm.nih.gov/protein/YP_001559043.1, accessed on May 1, 2013.
Accession No. AAL79562.1, NCBI Database, accessed at www.ncbi.nlm.nih.gov/protein/AAL79562.1, accessed on May 1, 2013.

(56) References Cited

OTHER PUBLICATIONS

Accession No. AAB41452.1, NCBI Database, accessed at www.ncbi.nlm.gov/protein/AAB41452.1, accessed on May 1, 2013.
Accession No. YP_002505595, NCBI Database, accessed at www.ncbi.nlm.gov/protein/YP_002505595, accessed on May 1, 2013.
Accession No. YP_002506548.1, NCBI Database, accessed at www.ncbi.nlm.gov/protein/YP_002506548.1, accessed on May 1, 2013.
Accession No. YP_902505091.1, NCBI Database, accessed at www.ncbi.nlm.gov/protein/YP_002505091.1, accessed on May 1, 2013.
Accession No. YP_002505438.1, NCBI Database, accessed at www.ncbi.nlm.gov/protein/YP_002505438.1, accessed on May 1, 2013.
Accession No. YP_002506705.1, NCBI Database, accessed at www.ncbi.nlm.gov/protein/YP_002506705.1, accessed on May 1, 2013.
Accession No. YP_002505090.1, NCBI Database, accessed at www.ncbi.nlm.gov/protein/YP_002505090.1, accessed on May 1, 2013.
Accession No. YP_002505196.1, NCBI Database, accessed at www.ncbi.nlm.gov/protein/YP_002505196.1, accessed on May 1, 2013.
Accession No. AAA73867.1, NCBI Database, accessed at www.ncbi.nlm.gov/protein/AAA73867.1, accessed on May 1, 2013.
Accession No. ABL73883.1, NCBI Database, accessed at www.ncbi.nlm.gov/protein/ABL73883.1, accessed on May 1, 2013.
Accession No. AAV64879.1, NCBI Database, accessed at www.ncbi.nlm.gov/protein/AAV64879.1, accessed on May 1, 2013.
Accession No. AAZ55112.1, NCBI Database, accessed at www.ncbi.nlm.gov/protein/AAZ55112.1, accessed on May 1, 2013.
Accession No. AAZ56745.1, NCBI Database, accessed at www.ncbi.nlm.gov/protein/AAZ56745.1, accessed on May 1, 2013.
Accession No. AAZ55642.1, NCBI Database, accessed at www.ncbi.nlm.gov/protein/AAZ55642.1, accessed on May 1, 2013.
Accession No. AAZ55664.1, NCBI Database, accessed at www.ncbi.nlm.gov/protein/AAZ55664.1, accessed on May 1, 2013.
Accession No. YP_290015.1, NCBI Database, accessed at www.ncbi.nlm.gov/protein/YP_90015.1, accessed on May 1, 2013.
Accession No. AAZ55700.1, NCBI Database, accessed at www.ncbi.nlm.gov/protein/AAZ55700.1, accessed on May 1, 2013.
Accession No. YP_288681.1, NCBI Database, accessed at www.ncbi.nlm.gov/protein/YP_288681.1, accessed on May 1, 2013.
Accession No. YP_288962.1, NCBI Database, accessed at www.ncbi.nlm.gov/protein/YP_288962.1, accessed on May 1, 2013.
Accession No. AAP56348.1, NCBI Database, accessed at www.ncbi.nlm.gov/protein/AAP56348.1, accessed on May 1, 2013.
Accession No. AAC06387.1, NCBI Database, accessed at www.ncbi.nlm.gov/protein/AAC06387.1, accessed on May 1, 2013.
Accession No. YP_289135.1, NCBI Database, accessed at www.ncbi.nlm.gov/protein/YP_289135.1, accessed on May 1, 2013.
Accession No. YP_289685.1, NCBI Database, accessed at www.ncbi.nlm.gov/protein/YP_289685.1, accessed on May 1, 2013.
Accession No. YP_001036701.1, NCBI Database, accessed at www.ncbi.nlm.gov/protein/YP_001036701.1, accessed on May 1, 2013.
Accession No. CAI06105.1, NCBI Database, accessed at www.ncbi.nlm.gov/protein/CAI06105.1, accessed on May 1, 2013.
Accession No. YP_001037053.1, NCBI Database, accessed at www.ncbi.nlm.gov/protein/YP_001037053.1, accessed on May 1, 2013.
Accession No. CAC27410.1, NCBI Database, accessed at www.ncbi.nlm.gov/protein/CAC27410.1, accessed on May 1, 2013.
Accession No. YP_001037893.1, NCBI Database, accessed at www.ncbi.nlm.gov/protein/YP_001037893.1, accessed on May 1, 2013.
Accession No. YP_001038519.1, NCBI Database, accessed at www.ncbi.nlm.gov/protein/YP_001038519.1, accessed on May 1, 2013.
Accession No. CAA42814.1, NCBI Database, accessed at www.ncbi.nlm.gov/protein/CAA42814.1, accessed on May 1, 2013.
Accession No. CAA33665.1, NCBI Database, accessed at www.ncbi.nlm.gov/protein/CAA33665.1, accessed on May 1, 2013.
Accession No. YP_001038942.1, NCBI Database, accessed at www.ncbi.nlm.gov/protein/YP_001038942.1, accessed on May 1, 2013.
Accession No. YP_001037698.1, NCBI Database, accessed at www.ncbi.nlm.gov/protein/YP_001037698.1, accessed on May 1, 2013.
Accession No. YP_001036474.1, NCBI Database, accessed at www.ncbi.nlm.gov/protein/YP_001036474.1, accessed on May 1, 2013.
Accession No. YP_001036843.1, NCBI Database, accessed at www.ncbi.nlm.gov/protein/YP_001036843.1, accessed on May 1, 2013.
Accession No. YP_001037253.1, NCBI Database, accessed at www.ncbi.nlm.gov/protein/YP_001037253.1, accessed on May 1, 2013.
Accession No. CAD48307, NCBI Database, accessed at www.ncbi.nlm.gov/protein/CAD48307, accessed on May 1, 2013.
Accession No. CAD48313, NCBI Database, accessed at www.ncbi.nlm.gov/protein/CAD48313, accessed on May 1, 2013.
Accession No. CAD48314, NCBI Database, accessed at www.ncbi.nlm.gov/protein/CAD48314, accessed on May 1, 2013.
Accession No. AJ508405, NCBI Database, accessed at www.ncbi.nlm.gov/nuccore/AJ508405, accessed on May 1, 2013.
Accession No. AJ508404, NCBI Database, accessed at www.ncbi.nlm.gov/nuccore/AJ508404, accessed on May 1, 2013.
Accession No. CAB08072, NCBI Database, accessed at www.ncbi.nlm.gov/protein/CAB08072, accessed on May 1, 2013.
Accession No. AJ508406, NCBI Database, accessed at www.ncbi.nlm.gov/nuccore/AJ508406, accessed on May 1, 2013.
Accession No. AAC28125, NCBI Database, accessed at www.ncbi.nlm.gov/protein/AAC28125, accessed on May 1, 2013.
Accession No. CAA39010, NCBI Database, accessed at www.ncbi.nlm.gov/protein/CAA39010, accessed on May 1, 2013.
Accession No. CAA93280, NCBI Database, accessed at www.ncbi.nlm.gov/protein/CAA93280, accessed or May 1, 2013.
Accession No. CAB06786, NCBI Database, accessed at www.ncbi.nlm.gov/protein/CAB06786, accessed on May 1, 2013.
Accession No. CAB01405, NCBI Database, accessed at www.ncbi.nlm.gov/protein/CAB01405, accessed on May 1, 2013.
Accession No. CAA93627, NCBI Database, accessed at www.ncbi.nlm.gov/protein/CAA93627, accessed on May 1, 2013.
Accession No. Z86104, NCBI Database, accessed at www.ncbi.nlm.gov/nuccore/Z86104, accessed on May 1, 2013.
Accession No. YP_002573059, NCBI Database, accessed at www.ncbi.nlm.gov/nuccore/YP_002573059, accessed on May 1, 2013.
Accession No. YP_002572493, NCBI Database, accessed at www.ncbi.nlm.gov/nuccore/YP_002572493, accessed on May 1, 2013.
Accession No. CAB15969.1, NCBI Database, accessed at www.ncbi.nlm.gov/protein/CAB15969.1, accessed on May 1, 2013.
Accession No. CAA99586.1, NCBI Database, accessed at www.ncbi.nlni.gov/protein/CAA99586.1, accessed on May 1, 2013.
Accession No. AL009126, NCBI Database, accessed at www.ncbi.nlm.gov/nuccore/AL009126, accessed on May 1, 2013.
Accession No. D85132, NCBI Database, accessed at www.ncbi.nlm.gov/nuccore/D85132, accessed on May 1, 2013.
Accession No. CP000885, NCBI Database, accessed at www.ncbi.nlm.gov/nuccore/CP000885, accessed on May 1, 2013.
Accession No. AAU40201.1, NCBI Database, accessed at www.ncbi.nlm.gov/protein/AAU40201.1, accessed on May 1, 2013.
Accession No. AAU41895.1, NCBI Database, accessed at www.ncbi.nlm.gov/protein/AAU41895.1, accessed on May 1, 2013.
Accession No. AAU43098.1, NCBI Database, accessed at www.ncbi.nlm.gov/protein/AAU43089.1, accessed on May 1, 2013.
Accession No. AAU43033.1, NCBI Database, accessed at www.ncbi.nlm.gov/protein/AAU43033.1, accessed on May 1, 2013.
Accession No. AAU39947.1, NCBI Database, accessed at www.ncbi.nlm.gov/protein/AAU39947.1, accessed on May 1, 2013.
Accession No. BAA23616.1, NCBI Database, accessed at www.ncbi.nlm.gov/protein/BAA23616.1, accessed on May 1, 2013.
Accession No. CAC83969.1, NCBI Database, accessed at www.ncbi.nlm.gov/protein/CAC83969.1, accessed on May 1, 2013.
Locus tag No. lp_2598, NCBI Database, accessed at www.ncbi.nlm.gov/gene/?term=lp_2598, accessed on May 1, 2013.
Locus tag No. lp_3313, NCBI Database, accessed at www.ncbi.nlm.gov/gene/?term=1P_3313, accessed on May 1, 2013.
Locus tag No. JDM1_2695, NCBI Database, accessed at www.ncbi.nlm.gov/gene/?term-JDM1_2695, accessed on May 1, 2013.
Locus tag No. JDM1_2087, NCBI Database, accessed at www.ncbi.nlm.gov/gene/?term=JDM1_2087, accessed on May 1, 2013.
Accession No. ACZ34302, NCBI Database, accessed at www.ncbi.nlm.gov/protein/ACZ34302, accessed on May 1, 2013.
Accession No. XP370166.2, NCBI Database, accessed at www.ncbi.nlm.gov/protein/XP370166.2?report-genpept, accessed on May 1, 2013.

(56) References Cited

OTHER PUBLICATIONS

Accession No. P07981, NCBI Database, accessed at www.ncbi.nlm.gov/protein/P07981, accessed on May 1, 2013.
Accession No. P07982, NCBI Database, accessed at www.ncbi.nlm.gov/protein/P07982, accessed on May 1, 2013.
Accession No. BAA20140, NCBI Database, accessed at www.ncbi.nlm.gov/protein/BAA20140, accessed on May 1, 2013.
Accession No. XP_001389416, NCBI Database, accessed at www.ncbi.nlm.gov/protein/XP_001389416, accessed on May 1, 2013.
Accession No. AAA67426, NCBI Database, accessed at www.ncbi.nlm.gov/protein/AAA67426, accessed on May 1, 2013.
Accession No. CAA93244, NCBI Database, accessed at www.ncbi.nlm.gov/protein/CAA93244, accessed on May 1, 2013.
Accession No. AAA93264, NCBI Database, accessed at www.ncbi.nlm.gov/protein/AAA93264, accessed on May 1, 2013.
Accession No. CAB92328, NCBI Database, accessed at www.ncbi.nlm.gov/protein/CAB92328, accessed on May 1, 2013.
Accession No. CAA03655.1, NCBI Database, accessed at www.ncbi.nlm.gov/protein/CAA03655.1, accessed on May 1, 2013.
Accession No. ABN67901, NCBI Database, accessed at www.ncbi.nlm.gov/protein/ABN67901, accessed on May 1, 2013.
Accession No. AAA22194.1, NCBI Database, accessed at www.ncbi.nlm.gov/protein/AAA22194.1, accessed on May 1, 2013.
Accession No. ACM91731.1, NCBI Database, accessed at www.ncbi.nlm.gov/protein/ACM91731.1, accessed on May 1, 2013.
Accession No. CAL64397.1, NCBI Database, accessed at www.ncbi.nlm.gov/protein/CAL64397.1, accessed on May 1, 2013.
Accession No. AAF23874.1, NCBI Database, accessed at www.ncbi.nlm.gov/protein/AAF23874.1, accessed on May 1, 2013.
Accession No. AAC00283.1, NCBI Database, accessed www.ncbi.nlm.gov/protein/AAC00283.1, accessed on May 1, 2013.
Accession No. AAG23399.1, NCBI Database, accessed at www.ncbi.nlm.gov/protein/AAG23399.1, accessed on May 1, 2013.
Accession No. BAA23408.1, NCBI Database, accessed at www.ncbi.nlm.gov/protein/BAA23408.1, accessed on May 1, 2013.
Accession No. ZP_03592919.1, NCBI Database, accessed at www.ncbi.nlm.gov/protein/ZP_03592919.1, accessed on May 1, 2013.
Accession No. BAA22245.1, NCBI Database, accessed at www.ncbi.nlm.gov/protein/BAA22245.1, accessed on May 1, 2013.
Accession No. AAA35107.1, NCBI Database, accessed at www.ncbi.nlm.gov/protein/AAA35107.1, accessed on May 1, 2013.
Accession No. AAP04499.1, NCBI Database, accessed at www.ncbi.nlm.gov/protein/AAP04499.1, accessed on May 1, 2013.
Accession No. BAA01540.1, NCBI Database, accessed at www.ncbi.nlm.gov/protein/BAA01540.1, accessed on May 1, 2013.
Accession No. BAA00033.1, NCBI Database, accessed at www.ncbi.nlm.gov/protein/BAA00033.1, accessed on May 1, 2013.
Accession No. CAA01355.1, NCBI Database, accessed at www.ncbi.nlm.gov/protein/CAA01355.1, accessed on May 1, 2013.
Accession No. AAU24646.1, NCBI Database, accessed at www.ncbi.nlm.gov/protein/AAU24646.1, accessed on May 1, 2013.
Accession No. ABE68909.1, NCBI Database, accessed at www.ncbi.nlm.gov/protein/ABE68909.1, accessed on May 1, 2013.
Accession No. ABJ99976.1, NCBI Database, accessed at www.ncbi.nlm.gov/protein/ABJ99976.1, accessed on May 1, 2013.
Accession No. AAZ77709.1, NCBI Database, accessed at www.ncbi.nlm.gov/protein/AAZ77709.1, accessed on May 1, 2013.
Accession No. CAB75696.1, NCBI Database, accessed at www.ncbi.nlm.gov/protein/CAB75696.1, accessed on May 1, 2013.
Accession No. AAL89553, NCBI Database, accessed at www.ncbi.nlm.gov/protein/AAL89553, accessed on May 1, 2013.
Accession No. AAA34210.1, NCBI Database, accessed at www.ncbi.nlm.gov/protein/AAA34210.1, accessed on May 1, 2013.
Accession No. AAA34212.1, NCBI Database, accessed at www.ncbi.nlm.gov/protein/AAA34212.1, accessed on May 1, 2013.
Accession No. ABA64553.1, NCBI Database, accessed at www.ncbi.nlm.gov/protein/ABA64553.1, accessed on May 1, 2013.
Accession No. CAA49294.1, NCBI Database, accessed at www.ncbi.nlm.gov/protein/CAA49294.1, accessed on May 1, 2013.
Accession No. CAK37179.1, NCBI Database, accessed at www.ncbi.nlm.gov/protein/CAK37179.1, accessed on May 1, 2013.
Accession No. CAK39870.1, NCBI Database, accessed at www.ncbi.nlm.gov/protein/CAK39870.1, accessed on May 1, 2013.
Accession No. CAA70510.1, NCBI Database, accessed at www.ncbi.nlm.gov/protein/CAA70510.1, accessed on May 1, 2013.
Accession No. CAA36967.1, NCBI Database, accessed at www.ncbi.nlm.gov/protein/CAA36967.1, accessed on May 1, 2013.
Accession No. CAA36966.1, NCBI Database, accessed at www.ncbi.nlm.gov/protein/CAA36966.1, accessed on May 1, 2013.
Accession No. AAS46914.1, NCBI Database, accessed at www.ncbi.nlm.gov/protein/AAS46914.1, accessed on May 1, 2013.
Accession No. AAS46913.1, NCBI Database, accessed at www.ncbi.nlm.gov/protein/AAS46913.1, accessed on May 1, 2013.
Accession No. BAA19473.1, NCBI Database, accessed at www.ncbi.nlm.gov/protein/BAA19473.1, accessed on May 1, 2013.
Accession No. XP_001402054.1, NCBI Database, accessed at www.ncbi.nlm.gov/protein/XP_001402054.1, accessed on May 1, 2013.
Accession No. XP_001389562.1, NCBI Database, accessed at www.ncbi.nlm.gov/protein/XP_001389562.1, accessed on May 1, 2013.
Accession No. CAK42510.1, NCBI Database, accessed at www.ncbi.nlm.gov/protein/CAK42510.1, accessed on May 1, 2013.
Accession No. CAK42333.1, NCBI Database, accessed at www.ncbi.nlm.gov/protein/CAK42333.1, accessed on May 1, 2013.
Accession No. XP_001401093.1, NCBI Database, accessed at www.ncbi.nlm.gov/protein/XP_001401093.1, accessed on May 1, 2013.
Accession No. NP_001104920.1, NCBI Database, accessed at www.ncbi.nlm.gov/protein/NP_001104920.1, accessed on May 2, 2013.
Accession No. ACY56113.1, NCBI Database, accessed at www.ncbi.nlm.gov/protein/ACY56113.1, accessed on May 2, 2013.
Accession No. ACG43008.1, NCBI Database, accessed at www.ncbi.nlm.gov/protein/ACG43008.1, accessed on May 2, 2013.
Accession No. ABG73613.1, NCBI Database, accessed at www.ncbi.nlm.gov/protein/ABG73613.1, accessed on May 2, 2013.
Accession No. ABF61784.1, NCBI Database, accessed at www.ncbi.nlm.gov/protein/ABF61784.1, accessed on May 2, 2013.
Accession No. CAA53632.1, NCBI Database, accessed at www.ncbi.nlm.gov/protein/CAA53632.1, accessed on May 2, 2013.
Accession No. CAD34597.1, NCBI Database, accessed at www.ncbi.nlm.gov/protein/CAD34597.1, accessed on May 2, 2013.
Accession No. AAQ67413.1, NCBI Database, accessed at www.ncbi.nlm.gov/protein/AAQ67413.1, accessed on May 2, 2013.
Accession No. ABL84490.1, NCBI Database, accessed at www.ncbi.nlm.gov/protein/ABL84490.1, accessed on May 2, 2013.
Accession No. NP_012687.1, NCBI Database, accessed at www.ncbi.nlm.gov/protein/NP_012687.1, accessed on May 2, 2013.
Accession No. AAR84199.1, NCBI Database, accessed at www.ncbi.nlm.gov/protein/AAR84199.1, accessed on May 2, 2013.
Accession No. NP_389746.1, NCBI Database, accessed at www.ncbi.nlm.gov/protein/NP_389746.1, accessed on May 2, 2013.
Accession No. YP_080606.1, NCBI Database, accessed at www.ncbi.nlm.gov/protein/YP_080606.1, accessed on May 2, 2013.
Accession No. YP_079258.1, NCBI Database, accessed at www.ncbi.nlm.gov/ptotein/YP_079258.1, accessed on May 2, 2013.
Accession No. CAB72125.1, NCBI Database, accessed at www.ncbi.nlm.gov/protein/CAB72125.1, accessed on May 2, 2013.
Accession No. CAB72126.1, NCBI Database, accessed at www.ncbi.nlm.gov/protein/CAB72126.1, accessed on May 2, 2013.
Accession No. XP_001390812.1, NCBI Database, accessed at www.ncbi.nlm.gov/protein/XP_001390812.1, accessed on May 2, 2013.
Accession No. CAB72931.1, NCBI Database, accessed at www.ncbi.nlm.gov/protein/CAB72931.1, accessed on May 2, 2013.
Accession No. CAK44164.1, NCBI Database, accessed at www.ncbi.nlm.gov/protein/CAK44164.1, accessed on May 2, 2013.
Accession No. CAK48529.1, NCBI Database, accessed at www.ncbi.nlm.gov/protein/CAK48529.1, accessed on May 2, 2013.
Accession No. CAK37997.1, NCBI Database, accessed at www.ncbi.nlm.gov/protein/CAK37997.1, accessed on May 2, 2013.

(56) References Cited

OTHER PUBLICATIONS

Accession No. AAW03313.1, NCBI Database, accessed at www.ncbi.nlm.gov/protein/AAW03313.1, accessed on May 2, 2013.
Accession No. CAK47350.1, NCBI Database, accessed at www.ncbi.nlm.gov/protein/CAK47350.1, accessed on May 2, 2013.
Accession No. ACE00421.1, NCBI Database, accessed at www.ncbi.nlm.gov/protein/ACE00421.1, accessed on May 2, 2013.
Accession No. CAA29233.1, NCBI Database, accessed at www.ncbi.nlm.gov/protein/CAA29233.1, accessed on May 2, 2013.
Accession No. AAA33923.1, NCBI Database, accessed at www.ncbi.nlm.gov/protein/AAA33923.1, accessed on May 2, 2013.
Accession No. CAA39501.1, NCBI Database, accessed at www.ncbi.nlm.gov/protein/CAA39501.1, accessed on May 2, 2013.
Accession No. AAB21151.2, NCBI Database, accessed at www.ncbi.nlm.gov/protein/AAB21151.2, accessed on May 2, 2013.
Accession No. CAA51912.1, NCBI Database, accessed at www.ncbi.nlm.gov/protein/CAA51912.1, accessed on May 2, 2013.
Accession No. CAA41120.1, NCBI Database, accessed at www.ncbi.nlm.gov/protein/CAA41120.1, accessed on May 2, 2013.
Accession No. CAF31354.1, NCBI Database, accessed at www.ncbi.nlm.gov/protein/CAF31354.1, accessed on May 2, 2013.
Accession No. AAC49622.1, NCBI Database, accessed at www.ncbi.nlm.gov/protein/AAC49622.1, accessed on May 2, 2013.
Accession No. AAO12212.1, NCBI Database, accessed at www.ncbi.nlm.gov/protein/AAO12212.1, accessed on May 2, 2013.
Accession No. ZP_03592917.1, NCBI Database, accessed at www.ncbi.nlm.gov/protein/ZP_03592917.1, accessed on May 2, 2013.
Accession No. ABX43202, NCBI Database, accessed at www.ncbi.nlm.gov/protein/ABX43202, accessed on May 2, 2013.
Accession No. ABX42665, NCBI Database, accessed at www.ncbi.nlm.gov/protein/ABX42665, accessed on May 2, 2013.
Accession No. ABX42692, NCBI Database, accessed at www.ncbi.nlm.gov/protein/ABX42692, accessed on May 2, 2013.
Accession No. ABX42702, NCBI Database, accessed at www.ncbi.nlm.gov/protein/ABX42702, accessed on May 2, 2013.
Accession No. ABX42703, NCBI Database, accessed at www.ncbi.nlm.gov/protein/ABX42703, accessed on May 2, 2013.
Accession No. ABX42704, NCBI Database, accessed at www.ncbi.nlm.gov/protein/ABX42704, accessed on May 2, 2013.
Accession No. ABX42705, NCBI Database, accessed at www.ncbi.nlm.gov/protein/ABX42705, accessed on May 2, 2013.
Accession No. ABX42711, NCBI Database, accessed at www.ncbi.nlm.gov/protein/ABX42711, accessed on May 2, 2013.
Accession No. ABX44132, NCBI Database, accessed at www.ncbi.nlm.gov/protein/ABX44132, accessed on May 2, 2013.
Accession No. ABX40605, NCBI Database, accessed at www.ncbi.nlm.gov/protein/ABX40605, accessed on May 2, 2013.
Accession No. ABX42246, NCBI Database, accessed at www.ncbi.nlm.gov/protein/ABX42246, accessed on May 2, 2013.
Accession No. ABN52030, NCBI Database, accessed at www.ncbi.nlm.gov/protein/ABN52030, accessed on May 2, 2013.
Accession No. ABN53008, NCBI Database, accessed at www.ncbi.nlm.gov/protein/ABN53008, accessed on May 2, 2013.
Accession No. ABN51356, NCBI Database, accessed at www.ncbi.nlm.gov/protein/ABN51356, accessed on May 2, 2013.
Accession No. ACL76625, NCBI Database, accessed at www.ncbi.nlm.gov/protein/ACL76625, accessed on May 2, 2013.
Accession No. ACL74721, NCBI Database, accessed at www.ncbi.nlm.gov/protein/ACL74721, accessed on May 2, 2013.
Accession No. AAZ54623, NCBI Database, accessed at www.ncbi.nlm.gov/protein/AAZ54623, accessed on May 2, 2013.
Accession No. AAZ55023, NCBI Database, accessed at www.ncbi.nlm.gov/protein/AAZ55023, accessed on May 2, 2013.
Accession No. AAZ54871, NCBI Database, accessed at www.ncbi.nlm.gov/protein/AAZ54871, accessed on May 2, 2013.
Accession No. AAZ54084, NCBI Database, accessed at www.ncbi.nlm.gov/protein/AAZ54084, accessed on May 2, 2013.
Accession No. AAZ55383, NCBI Database, accessed at www.ncbi.nlm.gov/protein/AAZ55383, accessed on May 2, 2013.
Accession No. AAZ55648, NCBI Database, accessed at www.ncbi.nlm.gov/protein/AAZ55648, accessed on May 2, 2013.
Accession No. ACM59580, NCBI Database, accessed at www.ncbi.nlm.gov/protein/ACM59580, accessed on May 2, 2013.
Accession No. ACM59734, NCBI Database, accessed at www.ncbi.nlm.gov/protein/ACM59734, accessed on May 2, 2013.
Accession No. ACM59378, NCBI Database, accessed at www.ncbi.nlm.gov/protein/ACM59378, accessed on May 2, 2013.
Accession No. ACM61134, NCBI Database, accessed at www.ncbi.nlm.gov/protein/ACM61134, accessed on May 2, 2013.
Accession No. AAA19800, NCBI Database, accessed at www.ncbi.nlm.gov/protein/AAA19800, accessed on May 2, 2013.
Accession No. BAC69017, NCBI Database, accessed at www.ncbi.nlm.gov/protein/BAC69017, accessed on May 2, 2013.
Accession No. BAC69435, NCBI Database, accessed at www.ncbi.nlm.gov/protein/BAC69435, accessed on May 2, 2013.
Accession No. BAC69862, NCBI Database, accessed at www.ncbi.nlm.gov/protein/BAC69862, accessed on May 2, 2013.
Accession No. BAC70500, NCBI Database, accessed at www.ncbi.nlm.gov/protein/BAC70500, accessed on May 2, 2013.
Accession No. BAC73692, NCBI Database, accessed at www.ncbi.nlm.gov/protein/BAC73692, accessed on May 2, 2013.
Accession No. BAC73693, NCBI Database, accessed at www.ncbi.nlm.gov/protein/BAC73693, accessed on May 2, 2013.
Accession No. BAC73694, NCBI Databae, accessed at www.ncbi.nlm.gov/protein/BAC73694, accessed on May 2, 2013.
Accession No. BAC69169, NCBI Database, accessed at www.ncbi.nlm.gov/protein/BAC69169, accessed on May 2, 2013.
Accession No. BAC73363, NCBI Database, accessed at www.ncbi.nlm.gov/protein/BAC72363, accessed on May 2, 2013.
Accession No. BAC73364, NCBI Database, accessed at www.ncbi.nlm.gov/protein/BAC73364, accessed on May 2, 2013.
Accession No. NP_827612, NCBI Database, accessed at www.ncbi.nlm.gov/protein/NP_827612, accessed on May 2, 2013.
Accession No. NP_827679, NCBI Database, accessed at www.ncbi.nlm.gov/protein/NP_827679, accessed on May 2, 2013.
Accession No. NP_821272, NCBI Database, accessed at www.ncbi.nlm.gov/protein/NP_821272, accessed on May 2, 2013.
Accession No. NP_823108, NCBI Database, accessed at www.ncbi.nlm.gov/protein/NP_823108, accessed on May 2, 2013.
Accession No. CAA86997.1, NCBI Database, accessed at www.ncbi.nlm.gov/protein/CAA86997.1, accessed on May 2, 2013.
Accession No. ACI10956.1, NCBI Database, accessed at www.ncbi.nlm.gov/protein/ACI10956.1, accessed on May 2, 2013.
Accession No. CAA48243.1, NCBI Database, accessed at www.ncbi.nlm.gov/protein/CAA48243.1, accessed on May 2, 2013.
Accession No. ADN65121.1, NCBI Database, accessed at www.ncbi.nlm.gov/protein/ADN65121.1, accessed on May 2, 2013.
Accession No. XM_001940921.1, www.ncbi.nlm.gov/nuccore/XM_001940921.1, accessed on May 2, 2013.
Accession No. EU106878, NCBI Database, accessed at www.ncbi.nlm.gov/nuccore/EU106878, accessed on May 2, 2013.
Accession No. Z69254, NCBI Database, accessed at www.ncbi.nlm.gov/nuccore/Z69254, accessed on May 2, 2013.
Accession No. CAA93246, NCBI Database, accessed at www.ncbi.nlm.gov/protein/CAA93246, accessed on May 2, 2013.
Accession No. YP_290232, NCBI Database, accessed at www.ncbi.nlm.gov/protein/YP_290232, accessed on May 2, 2013.
Accession No. CAA93247.1, NCBI Database, accessed at www.ncbi.nlm.gov/protein/CAA93247.1, accessed on May 2, 2013.
Accession No. CAK38067.1, NCBI Database, accessed at www.ncbi.nlm.gov/protein/CAK38067.1, accessed on May 2, 2013.
Accession No. CAB76571.1, NCBI Database, accessed at www.ncbi.nlm.gov/protein/CAB76571.1, accessed on May 2, 2013.
Accession No. AAO75900.1, NCBI Database, accessed at www.ncbi.nlm.gov/protein/AAO75900.1, accessed on May 2, 2013.
Accession No. ACU59425.1, NCBI Database, accessed at www.ncbi.nlm.gov/protein/ACU59425.1, accessed on May 2, 2013.
Accession No. ABR42553.1, NCBI Database, accessed at www.ncbi.nlm.gov/protein/ABR42553.1, accessed on May 2, 2013.
Accession No. CAA97220.1, NCBI Database, accessed at www.ncbi.nlm.gov/protein/CAA97220.1, accessed on May 2, 2013.

(56) References Cited

OTHER PUBLICATIONS

Accession No. CAA58554.1, NCBI Database, accessed at www.ncbi.nlm.gov/protein/CAA58554.1, accessed on May 2, 2013.
Accession No. CAA64017.1, NCBI Database, accessed at www.ncbi.nlm.gov/protein/CAA64017.1, accessed on May 2, 2015.
Accession No. CAA51693.1, NCBI Database, accessed at www.ncbi.nlm.gov/protein/CAA51693.1, accessed on May 2, 2013.
Accession No. CAA34078.1, NCBI Database, accessed at www.ncbi.nlm.gov/protein/CAA34078.1, accessed on May 2, 2013.
Accession No. AAO75458.1, NCBI Database, accessed at www.ncbi.nlm.gov/protein/AAO75458.1, accessed on May 2, 2013.
Accession No. AAC49461.1, NCBI Database, accessed at www.ncbi.nlm.gov/protein/AAC49461.1, accessed on May 2, 2013.
Accession No. AAO75460, NCBI Database, accessed at www.ncbi.nlm.gov/protein/AAO75460, accessed on May 2, 2013.
Accession No. EES69904.1, NCBI Database, accessed at www.ncbi.nlm.gov/protein/EES69904.1, accessed on May 2, 2013.
Accession No. BAF39100.1, NCBI Database, accessed at www.ncbi.nlm.gov/protein/BAF39100.1, accessed on May 2, 2013.
Accession No. ABG73614.1, NCBI Database, accessed at www.ncbi.nlm.nih.gov/protein/ABG73614.1, accessed on May 2, 2013.
Accession No. CAK47350.1, NCBI Database, accessed at www.ncbi.nlm.nih.gov/protein/CAK47350.1, accessed on May 2, 2013.
International Preliminary Report on Patentability for International Application No. PCT/US2011/039192, US Patent Office, United States, issued Dec. 4, 2012.
Ashikari, T., et al., "*Rhizopus* Raw-Starach-Degrading Glucoamylase: Its Cloning and Expression in Yeast," *Agric. Biol. Chem.* 50(4):957-964, Japan Society for Bioscience, Biotechnology, and Agrochemistry, Japan (1986).
Birol, G., et al., "Ethanol production and fermentation characteristics of recombinant *Saccharomyces cerevisiae* strains grown on starch," *Enzyme and Microbial Technology* 22:672-677, Elsevier Science Inc., United States (1998).
Eksteen, J.M., et al., "Starch Fermentation by Recombinant *Saccharomyces cerevisiae* Strains Expressing the α-Amylase and Glucoamylase Genes From *Lipomyces kononenkoae* and *Saccharomycopsis fibuligera*," *Biotechnol Bioeng* 84:639-646, Wiley Periodicals, Inc., United States (2003).
Nielsen, J., et al., "Metabolic engineering of yeast for production of fuels and chemicals," *Current Opinion in Biotechnology* 24:1-7, Elsevier Ltd., England (2013).
Pagliardini, J., et al., "The metabolic costs of improving ethanol yield by reducing glycerol formation capacity under anaerobic conditions in *Saccharomyces cerevisiae*," *Microbial Cell Factories* 12:1-14, BioMed Central Ltd., England (2013).
Shigechi, H., et al., "Efficient ethanol production from starch through development of novel flocculent yeast strains displaying glucoamylase and co-displaying or secreting α-amylase," *Journal of Molecular Catalysis B. Enzymatic* 17:179-187, Elsevier Science B.V., Netherlands (2002).
Extended European Search Report, dated Nov. 6, 2013, for European Application No. EP 11 79 0526.
Unpublished co-pending U.S. Appl. No. 13/941,175, filed Jul. 12, 2013.

[No Author Listed] Accession No. AlDBP9, UnitProt Database. Version 43, Dated Jun. 11, 2014. Retrieved Nov. 13, 2014, 3 pages.
[No Author Listed] Accession No. A2QFV7, UniProt Database, Version 44, Dated Nov. 13, 2013, 2 pages.
[No Author Listed] Accession No. A6ZNU5, UniProt Database, Version 31, Dated Oct. 29, 2014, 2 pages.
[No Author Listed] Accession No. ADF15319.1, GenBank Database, accessed at <www.ncbi.nlm.nih.gov/protein/ADF15319.1>, Apr. 12, 2010, Sequence 24 from patent U.S. Pat. No. 7,666,648, 1 page.
[No Author Listed] Accession No. B2WKW5, UniProt Database, Version 25, Dated May 14, 2014. Retrieved Nov. 14, 2014, 2 pages.
[No Author Listed] Accession No. P15019, UniProt Database, Version 137, Dated Oct. 29, 2014, 4 pages. Secondary Accession No. D6VYZ2.
[No Author Listed] Accession No. P22506, UniProt Database, Version 62, Dated Oct. 16, 2013, 3 pages.
[No Author Listed] Accession No. P22861.1, UniProt Database, Apr. 14, 2009, 3 pgs.
[No Author Listed] Accession No. P23254, UniProt Database, Version 157, Dated Oct. 29, 2014, 5 pages. Secondary Accession No. D6W478.
[No Author Listed] Accession No. P42826, UniProt Database, Version 117, Dated Oct. 29, 2014, 4 pages. Secondary Accession No. D6VUX6.
[No Author Listed] Accession No. Q92456, UniProt Database, Version 75, Dated Jun. 11, 2014, 3 pages.
Chi, et al., Saccharomycopsis fibuligera and its applications in biotechnology. Biotechnol Adv. Jul.-Aug. 2009;27 (4):423-31. doi: 10.10161Lbiotechadv2009.03.003. Epub Mar. 27, 2009.
Chinese Office Action for Application No. 201180035781.2, issued Feb. 27, 2014 (14 pages).
Chinese Office Action for Application No. 201180035781.2, issued Oct. 31, 2014 (28 pages).
Hostinová, et al., Molecular cloning and 3D structure prediction of the first raw-starch-degrading glucoamylase without a separate starch-binding domain. Arch Biochem Biophys. Mar. 15, 2003;411(2):189-95.
Inlow, et al., Fermentation of corn starch to ethanol with genetically engineered yeast. Biotechnol Bioeng. Jul. 5, 1988;32(2):227-34.
Nakamura, Y., et al., Alcohol fermentation of starch by a genetic recombinant yeast having glucoamylase activity. Biotechnol Bioeng. Jan. 5, 1997;53(1):21-5.
Shigechi, H., et al., Energy-saving direct ethanol production from low-temperature-cooked corn starch using a cell-surface engineered yeast strain co-displaying glucoamylase and ?-amylase. Biochemical Engineering Journal, vol. 18, Issue 2, May 2004, pp. 149-153.
Shigechi, H., et a., Direct Production of Ethanol from Raw Corn Starch via Fermentation by Use of a Novel Surface-Engineered Yeast Strain Codisplaying Glucoamylase and ?-Amylase. Appl Environ Microbiol. Aug. 2004; 70(8): 5037-5040.
Weinzierl, Gerhard, MD, Jul. 10, 2015 Letter from Schiweck Weinzierl Koch, life science re: Disclosures in U.S. Appl. No. 14/178,653. 2 pages.
Zhang, Z., Recombinant Yeast Strain Expressing Glucoamylase has been developed in Japan. Development in Bioengineering, Dec. 31, 1987, 2 pages. Chinese lagnuage document.

\* cited by examiner

AE9(Nat) at FCY
14112bp

YEAST EXPRESSING SACCHAROLYTIC ENZYMES FOR CONSOLIDATED BIOPROCESSING USING STARCH AND CELLULOSE

CROSS-REFERENCE TO RELATED APPLICATIONS

This application is a continuation of U.S. application Ser. No. 13/701,652, which is the National Stage of International Application Number PCT/US2011/039192, filed Jun. 3, 2011, which claims the benefit of U.S. Provisional Application No. 61/351,165, filed Jun. 3, 2010, and U.S. Provisional Application No. 61/420,142, filed Dec. 6, 2010, each of which are incorporated by reference herein.

REFERENCE TO A SEQUENCE LISTING SUBMITTED ELECTRONICALLY VIA EFS-WEB

The content of the electronically submitted sequence listing (Name: 2608_0490003sequence_listing_ascii.txt; Size: 1,995,359 bytes; and Date of Creation: Feb. 10, 2014) is herein incorporated by reference in its entirety.

BACKGROUND OF THE INVENTION

Biomass is biological material from living, or recently living organisms, such as wood, waste, (hydrogen) gas, and alcohol fuels. Biomass is carbon, hydrogen and oxygen based. Nitrogen and small quantities of other atoms, including alkali, alkaline earth and heavy metals can be found as well. Metals are often found in functional molecules such as the porphyrins which include chlorophyll which contains magnesium. Plants in particular combine water and carbon dioxide to sugar building blocks. The required energy is produced from light via photosynthesis based on chlorophyll. On average, between 0.1 and 1% of the available light is stored as chemical energy in plants. The sugar building blocks are the starting point for all of the major fractions found in terrestrial plants, lignin, hemicellulose and cellulose. Biomass is widely recognized as a promising source of raw material for production of renewable fuels and chemicals. The primary obstacle impeding the more widespread production of energy from biomass feedstocks is the general absence of low-cost technology for overcoming the recalcitrance of these materials to conversion into useful fuels. Biomass contains carbohydrate fractions (e.g., starch, cellulose, and hemicellulose) that can be converted into ethanol. In order to convert these fractions, the starch, cellulose, and, hemicellulose must ultimately be converted or hydrolyzed into monosaccharides; it is the hydrolysis that has historically proven to be problematic.

Biologically mediated processes are promising for energy conversion, in particular for the conversion of biomass into fuels. Biomass processing schemes involving enzymatic or microbial hydrolysis commonly involve four biologically mediated transformations: (1) the production of saccharolytic enzymes (amylases, cellulases and hemicellulases); (2) the hydrolysis of carbohydrate components present in pretreated biomass to sugars; (3) the fermentation of hexose sugars (e.g., glucose, mannose, and galactose); and (4) the fermentation of pentose sugars (e.g., xylose and arabinose). These four transformations occur in a single step in a process configuration called consolidated bioprocessing (CBP), which is distinguished from other less highly integrated configurations in that it does not involve a dedicated process step for cellulase and/or hemicellulase production.

CBP offers the potential for lower cost and higher efficiency than processes featuring dedicated saccharolytic enzyme production. The benefits result in part from avoided capital costs, substrate and other raw materials, and utilities associated with saccharolytic enzyme production. In addition, several factors support the realization of higher rates of hydrolysis, and hence reduced reactor volume and capital investment using CBP, including enzyme-microbe synergy and the use of thermophilic organisms and/or complexed saccharolytic systems. Moreover, cellulose-adherent cellulolytic microorganisms are likely to compete successfully for products of cellulose hydrolysis with non-adhered microbes, e.g., contaminants, which could increase the stability of industrial processes based on microbial cellulose utilization. Progress in developing CBP-enabling microorganisms is being made through two strategies: engineering naturally occurring saccharolytic microorganisms to improve product-related properties, such as yield and titer; and engineering non-saccharolytic organisms that exhibit high product yields and titers to express a heterologous saccharolytic enzyme system enabling starch, cellulose, and, hemicellulose utilization.

The breakdown of starch down into sugar requires amylolytic enzymes. Amylase is an example of an amylolytic enzyme that is present in human saliva, where it begins the chemical process of digestion. The pancreas also makes amylase (alpha amylase) to hydrolyze dietary starch into disaccharides and trisaccharides which are converted by other enzymes to glucose to supply the body with energy. Plants and some bacteria also produce amylases. Amylases are glycoside hydrolases and act on α-1,4-glycosidic bonds.

Several amylolytic enzymes are implicated in starch hydrolysis. Alpha-amylases (EC 3.2.1.1) (alternate names: 1,4-α-D-glucan glucanohydrolase; glycogenase) are calcium metalloenzymes, i.e., completely unable to function in the absence of calcium. By acting at random locations along the starch chain, alpha-amylase breaks down long-chain carbohydrates, ultimately yielding maltotriose and maltose from amylose, or maltose, glucose and "limit dextrin" from amylopectin. Because it can act anywhere on the substrate, alpha-amylase tends to be faster-acting than beta-amylase. Another form of amylase, beta-amylase (EC 3.2.1.2) (alternate names: 1,4-α-D-glucan maltohydrolase; glycogenase; saccharogen amylase) catalyzes the hydrolysis of the second α-1,4 glycosidic bond, cleaving off two glucose units (maltose) at a time. The third amylase is gamma-amylase (EC 3.2.1.3) (alternate names: Glucan 1,4-α-glucosidase; amyloglucosidase; Exo-1, 4-α-glucosidase; glucoamylase; lysosomal α-glucosidase; 1,4-α-D-glucan glucohydrolase). In addition to cleaving the last α(1-4)glycosidic linkages at the nonreducing end of amylose and amylopectin, yielding glucose, gamma-amylase will cleave α(1-6) glycosidic linkages.

A fourth enzyme, alpha-glucosidase, acts on maltose and other short malto-oligosaccharides produced by alpha-, beta-, and gamma-amylases, converting them to glucose.

Three major types of enzymatic activities are required for native cellulose degradation: The first type are endoglucanases (1,4-β-D-glucan 4-glucanohydrolases; EC 3.2.1.4). Endoglucanases cut at random in the cellulose polysaccharide chain of amorphous cellulose, generating oligosaccharides of varying lengths and consequently new chain ends. The second type are exoglucanases, including cellodextrinases (1,4-β-D-glucan glucanohydrolases; EC 3.2.1.74) and cellobiohydrolases (1,4-β-D-glucan cellobiohydrolases; EC 3.2.1.91). Exoglucanases act in a processive manner on the reducing or non-reducing ends of cellulose polysaccharide chains, liberating either glucose (glucanohydrolases) or cellobiose (cellobiohydrolase) as major products. Exoglucanases can also act on microcrystalline cellulose, presumably peeling cellulose chains from the microcrystalline structure. The third type are β-glucosidases (β-glucoside glucohydrolases; EC 3.2.1.21). β-Glucosidases hydrolyze soluble cellodextrins and cellobiose to glucose units.

A variety of plant biomass resources are available as starch and lignocellulosics for the production of biofuels, notably bioethanol. The major sources are (i) wood residues from paper mills, sawmills and furniture manufacturing, (ii) municipal solid wastes, (iii) agricultural residues and (iv) energy crops such as corn. Pre-conversion of particularly the cellulosic fraction in these biomass resources (using either physical, chemical or enzymatic processes) to fermentable sugars (glucose, cellobiose, maltose, alpha- and cellodextrins) would enable their fermentation to bioethanol, provided the necessary fermentative micro-organism with the ability to utilize these sugars is used.

On a world-wide basis, $1.3 \times 10^{10}$ metric tons (dry weight) of terrestrial plants are produced annually (Demain, A. L., el al., *Microbiol. Mol. Biol. Rev.* 69, 124-154 (2005)). Plant biomass consists of about 40-55% cellulose, 25-50% hemicellulose and 10-40% lignin, depending whether the source is hardwood, softwood, or grasses (Sun, Y. and Cheng. J., *Bioresource Technol.* 83, 1-11 (2002)). The major polysaccharide present is water-insoluble, cellulose that contains the major fraction of fermentable sugars (glucose, cellobiose or cellodextrins).

Bakers' yeast (*Saccharomyces cerevisiae*) remains the preferred micro-organism for the production of ethanol (Hahn-Hägerdal, B., et al., *Adv. Biochem. Eng. Biotechnol.* 73, 53-84 (2001)). Attributes in favor of this microbe are (i) high productivity at close to theoretical yields (0.51 g ethanol produced/g glucose used), (ii) high osmo- and ethanol tolerance, (iii) natural robustness in industrial processes, (iv) being generally regarded as safe (GRAS) due to its long association with wine and bread making, and beer brewing. Furthermore, *S. cerevisiae* exhibits tolerance to inhibitors commonly found in hydrolyzaties resulting from biomass pretreatment. The major shortcoming of *S. cerevisiae* is its inability to utilize complex polysaccharides such as starch and cellulose, or its break-down products, such as cellobiose and cellodextrins.

Genes encoding cellobiohydrolases in *T. reseei* (CBH1 and CBH2), *A. niger* (CBHA and CBHB) and *P. chrysosporium* (CBH1-4) have been cloned and described. The proteins encoded by these genes are all modular enzymes containing a catalytic domain linked via a flexible liner sequence to a cellulose-binding molecule. CBH2 and CBHB are family 6 glycosyl hydrolases. CBH1 and CBH1-4 are family 7 glycosyl hydrolases. Glycosyl hydrolases are a widespread group of enzymes that hydrolyze the glycosidic bond between two or more carbohydrates, or between a carbohydrate and a non-carbohydrate moiety. A classification system for glycosyl hydrolases, based on sequence similarity, has led to the definition of 85 different families (Henrissat, B. et al., *Proc. Natl. Acad. Sci.* 92:7090-7094 (1995); Davies, G. and Henrissat, B., *Structure* 3: 853-859 (1995)). Glycoside hydrolase family 7 (GHF7) comprises enzymes with several known activities including endoglucanase and cellobiohydrolase. These enzymes were formerly known as cellulase family C.

Cellobiohydrolases play a role in the conversion of cellulose to glucose by cutting the disaccharide cellobiose from the reducing (CBH1; GHF7) or nonreducing (CBH2; GHF6) end of the cellulose polymer chain. Structurally, cellulases and xylanases generally consist of a catalytic domain joined to a cellulose-binding domain (CBD) via a linker region that is rich in proline and/or hydroxy-amino acids. In type I exoglucanases, the CBD domain is found at the C-terminal extremity of these enzyme (this short domain forms a hairpin loop structure stabilised by 2 disulphide bridges). Some cellulases have only the catalytic domain.

Glycosyl hydrolase family 7 enzymes have a 67% homology at the amino acid level, but the homology between any of these enzymes and the glycosyl hydrolase family 6 CBH2 is less than 15%.

With the aid of recombinant DNA technology, several of these heterologous cellulases from bacterial and fungal sources have been transferred to *S. cerevisiae*, enabling the degradation of cellulosic derivatives (Van Rensburg, P., et al., Yeast 14, 67-76 (1998)), or growth on cellobiose (Van Rooyen. R., et al., *J. Biotech.* 120, 284-295 (2005)); McBride, J. E., et al., *Enzyme Microb. Techol.* 37, 93-101 (2005)).

Related work was described by Fujita. Y., et al., (*Appl. Environ. Microbiol.* 70, 1207-1212 (2004)) where cellulases immobilised on the yeast cell surface had significant limitations. Firstly, Fujita et al. were unable to achieve fermentation of amorphous cellulose using yeast expressing only recombinant BGL1 and EGII. A second limitation of the Fujita et al. approach was that cells had to be pre-grown to high cell density on standard carbon sources before the cells were useful for ethanol production using amorphous cellulose (e.g., Fujita et al. teaches high biomass loadings of ~15 g/L to accomplish ethanol production).

As noted above, ethanol producing yeast such as *S. cerevisiae* require addition of external cellulases when cultivated on cellulosic substrates such as pre-treated wood because this yeast does not produce endogenous cellulases. Functional expression of fungal cellulases such as *T. reesei* CBH1 and CBH2 in yeast *S. cerevisiae* have been demonstrated (Den Haan R et al., *Metab Eng.*, 9, 87-94 (2007)). However, current levels of expression and specific activity of cellulases heterologously expressed in yeast are still not maximally efficient with respect to the lignocellulosic substrate. Thus, there remains a significant need for improvement in the amount and variety of cellulase activity expressed in order to attain the goal of achieving a consolidated bioprocessing (CBP) system capable of efficiently and cost-effectively converting cellulosic substrates to ethanol.

The composition of lignocellulosic material varies greatly based on its species of origin, the particular tissue from which it is derived, and its pretreatment. Because of its varied composition, organisms designed for CBP must produce digestive enzymes that can accommodate a variety of substrates, in a variety of conformations, in a variety of reaction environments. To date, efficient usage of lignocellulosic substrates requires the addition of external enzymes at high levels and externally added enzymes are costly. Therefore it would be very beneficial to isolate cellulases from cellulolytic organisms with high specific activity and high expression levels in host organisms, such as the yeast *S. cerevisiae* in order to achieve CBP. Also, in order to use lignocellulosic material with maximal efficiency, it would also be beneficial to discover combinations of paralogous and/or orthologous enzymes that work synergistically to achieve more efficient break down of lignocellulosic components.

The secretome of *Trichoderma reesei* consists of 22 unique identifiable protein species (Herpoël-Gimbert I, Margeot A, Dolla A, et al., Comparative secretome analyses of two *Trichoderma reesei* RUT-C30 and CL847 hypersecretory strains, *Biotechnol Biofuels.* 2008 Dec. 23; 1(1):18), identified by 2D gel electrophoresis and MALDI-TOF mass spectrometry. However, a study of the complementation of the *T. reesei* system, showed that the addition of a small amount of supernatant from other cellulolytic fungi provided a substantial increase in activity for *T. reesei* cellulase preparations (Rosgaard L, Pedersen S, Cherry J R, et al., Efficiency of new fungal cellulase systems in boosting enzymatic degradation of barley straw lignocellulose, *Biotechnol Prog.* 2006 March-April; 22(2):493-8). In addition to this, a comparison of the *T. reesei* genome to several other cellulolytic fungi (Martinez D, Berka R M. Henrissat B, et al., Genome sequencing and analysis of the biomass-degrading fungus *Trichoderma reesei* (syn. *Hypocrea jecorina*), *Nat Biotechnol.* 2008 May; 26(5): 553-60) found that its genome encodes fewer cellulases and hemicellulases than all of the other sequenced cellulolytic fungi, and may be particularly deficient in hemicellulose degradation since it is missing the tannase and feruoyl esterase enzyme families completely. These studies suggest that activities not present in the *T. reesei* genome may also be useful for hydrolyzing lignocellulose.

In addition, literature on reconstituted cellulase systems from fungi do provide some insight into which enzymes (and how much) are needed for hydrolysis. Gusakov A V, Salanovich T N, Antonov A I, et al., Design of highly efficient cellulase mixtures for enzymatic hydrolysis of cellulose. *Biotechnol Bioeng.* 2007 Aug. 1:97(5):1028-38 used purified *Chrysosporium lucknowense* cellulases, and showed that a mixture of CBH1, CBH2, EG2, EG5, BGL, and XYN2 could extensively hydrolyze Organosolv pretreated douglas fir. Because the Organosolv pretreatment extensively removes lignin, it is likely it would remove the need for some enzyme activities in addition. In another study (Zhou J, Wang Y H, Chu J, et al., Optimization of cellulase mixture for efficient hydrolysis of steam-exploded corn stover by statistically designed experiments, *Bioresour Technol.* 2009 January; 100 (2):819-25. Epub 2008 Sep. 3), ~80% of the glucan in pretreated corn stover could be converted by a mix of 7 enzymes, including CBH1, CBH2, EG1, EG3, EG4, and BGL. In the optimized mix created by the authors, the CBHs made up about two-thirds of the total cellulase, and the ratio of CBH2 to CBH1 was 2:1. In both of these studies, the reconstituted systems showed greater total hydrolysis than the crude enzyme preparation, although this is likely a function of the pretreatment conditions.

Beyond fungi, there are a large variety of cellulolytic bacteria that can be used as gene donors for expression of lignocellulolytic enzymes in yeast. In one aspect, the present invention is drawn to identifying cellulolytic enzymes from a variety of organisms and subsequently identifying enzymes that work in maximally efficient combinations to digest lignocellolosic material. Given the diversity of cellulolytic bacteria, classification of these organisms based on several parameters (Lynd et al., 2002) may inform the choice of gene donors. The following are possible distinguishing characteristics: A) aerobic vs. anaerobic, B) mesophiles vs. thermophiles; and C) noncomplexed, cell free enzymes vs. complexed, cell bound enzymes.

Another consideration when defining the needed set of enzymatic activities is to attempt to characterize the linkages in a lignocellulosic substrate. The following is an analysis for a hardwood substrate. FIG. 1 provides an overview of the carbohydrate structures present in plant material given in Van Zyl W H et al., Consolidated bioprocessing for bioethanol production using *Saccharomyces cerevisiae, Adv Biochem Eng Biotechnol.*, 108, 205-235 (2007). Although this depiction is not specific to hardwoods, it corresponds relatively well with information from the *Handbook of Wood Chemistry and Composites* (Rowell, 2005), which states that hardwood hemicelluloses have the following characteristics: Largely comprised of glucuronoxylans—similar to structure (B) from FIG. 1. These have a xylan backbone (beta 1-4 linked xylopyranose units) with acetyl groups at C2 or C-3, average of 7 acetyls per ten xylose units, and are substituted with sidechains of 4-O-methylglucuronic acid (alpha 1-2 linkage). Hardwoods contain 2-5% of a glucomannan composed of beta-D-glucopyranose and beta-D-mannopyranose units linked 1-4—somewhat similar to structure (C) from FIG. 1; and hardwoods contain small amounts of pectins, starch and proteins.

Panel F from FIG. 1 gives the structure for a type of xylan-lignin linkage, as well as the 4-O-methylglucuronic acid linkage to xylan that are associated with hardwoods. This figure was taken from Spanikova S and Biely P, *FEBS Lett.*, 580, 4597-4601 (2006). The authors of this paper identified an enzyme, glucuronoyl esterase, which acts on these linkages. They identified the *T. reesei* Cip2 as a homologue of this enzyme.

In order to address the limitations of heterologous cellulase expression in consolidated bioprocessing systems, in one aspect, the present invention provides for the identification of novel saccharolytic enzymes that are capable of facilitating efficient cellulase digestion and fermentation product production in host cells. In particular, in one embodiment, the present invention is directed to the isolation of novel genes for saccarolytic enzymes from cellulolytic organisms. The present invention provides novel genes that are capable of being heterologously expressed in yeast systems and facilitate the digestion of starch, pentose sugars, and lignocellulosic components. Specifically, the present invention provides in one embodiment for novel genes for saccharolytic enzymes from a variety of bacterial, fungal, non-conventional yeast, and plant organisms which can be expressed in yeast.

In another aspect, the present invention also describes industrial yeast strains that express enzymes for the production of fuel ethanol from corn starch.

Even though yeast strains expressing enzymes for the production of fuel ethanol from whole grain or starch have been previously disclosed, the application has not been commercialized in the grain-based fuel ethanol industry, due to the relatively poor ability of the resulting strains to produce/tolerate high levels of ethanol. For example, U.S. Pat. No. 7,226,776 discloses that a polysaccharase enzyme expressing ethanologen can make ethanol directly from carbohydrate polymers, but the maximal ethanol titer demonstrated is 3.9 g/l. U.S. Pat. No. 5,422,267 discloses the use of a glucoamylase in yeast for production of alcoholic beverages; however, no commercially relevant titers of ethanol are disclosed.

Additionally, although yeast cells are known to naturally utilize sugars such as glucose and mannose, they lack the ability to efficiently utilize pentose sugars such as xylose and arabinose.

Therefore, in one embodiment, the present invention describes industrial yeast strains that are engineered to express a broad spectrum of various saccharolytic enzymes as well as pentose utilization pathways for production of various compounds from biomass feedstock containing mix of hexose and pentose mono- and poly-saccharides.

Engineering and utilization of such yeast strain(s) would allow a bioprocess with a biomass feedstock. Such biomass feedstock could include several different polymeric compounds such as: cellulose, hemicellulose, starch, pectin, inulin, levan and others. Also, the biomass feedstock could contain the mix of pentose and hexose carbohydrates. Therefore, complex substrates derived from plants such as wood, corn, agave, switch grass and others that contain combination of different carbohydrates and carbohydrate polymers could be utilized in a bioprocess without prior separation of different substrates. Furthermore, substrates derived from different sources could be combined in the same bioprocess. The substrates could be derived directly from plants or from any kind of waste or byproducts containing carbohydrates.

The present invention represents the first demonstration of a full CBP effect at commercial ethanol production level, wherein yeast produced enzymes completely replace exogenous enzyme added in standard commercial process. As a result, a yeast CBP strain was able to produce over 125 g/l ethanol from liquefied corn mash in 72 hrs without any exogenous enzymes added. This was achieved due to engineering selected set of enzymes into an industrial robust background strain. The resulting strains may also be used to produce ethanol directly from granular starch without liquefaction.

BRIEF SUMMARY OF THE INVENTION

In some embodiments, the invention comprising a yeast strain, or strains, secreting a full suite, or a subset of that full suite, of enzymes to hydrolyze lignocellulose, including enzymes that hydrolyze chemical linkages in cellulose, hemicellulose, and between lignin and carbohydrates. In some embodiments, the invention is also a set of proteins that are well-expressed in yeast for each category of necessary enzymatic activity in order to efficiently utilize a particular lignocellulosic material. This full suite of enzymes contains activities beyond those identified previously for expression in yeast: CBH1 CBH2, EG, and BGL (as disclosed e.g. in PCT Application No. PCT/US2009/065571). In some embodiments, the present invention relates to a yeast cell that expresses one or more gene products of the genes: *Aspergillus fumigatus* Endoglucanase (Accession No. XP_747897); *Neosartorya fischeri* Endoglucanase (Accession No. XP_001257357); *Aspergillus clavatus* Endoglucanase (Accession No. XP_001270378); *Aspergillus terreus* Endoglucanase (Accession No. XP_001217291); *Penicillium marneffei* Endoglucanase (Accession No. XP_002152969); *Chaetomium globosum* Endoglucanase (Accession No. XP_001229968); *Neurospora crassa* Endoglucanase (Accession No. XP_956431); *Aspergillus oryzae* Endoglucanase (Accession No. BAA22589); *Thielavia heterothallica* Endoglucanase (Accession No. AAE25067); *Fusarium oxysporum* Endoglucanase (Accession No. AAG09047); *Humicola insolens* Endoglucanase (Accession No. IDYM_A); *Pyrenophora tritici-repentis* Endoglucanase (Accession No. XP_001935476); *Magnaporthe grisea* Endoglucanase (Accession No. XP_370166); *Fusarium graminearum* Endoglucanase (Accession No. XP_388429); *Chrysosporium lucknowense* Endoglucanase; *Polyporus arcularius* Endoglucanase (Accession No. BAF75943.1); *Aspergillus kawachii* Endoglucanase (Accession No. BAB62317.1); *Heterodera schachtii* Endoglucanase (Accession No. CAC12958.1); *Orpinomyces* sp. Endoglucanase (Accession No. AAD04193.1); *Irpex lacteus* Endoglucanase (Accession No. BAD67544.1); *Chaetomium globosum* Endoglucanase (Accession No. XP_001220409.1); *Aspergillus niger* Endoglucanase (Accession No. XP_001397982.1); *Penicillium decumbens* Endoglucanase (Accession No. ABY28340.1); *Phanerochaete chrysosporium* Endoglucanase (Accession No. AAU12276); *Stachybotrys echinata* Endoglucanase (Accession No. AAM77710); *Neosartorya fischeri* Endoglucanase (Accession No. XP_001261563); *Chaetomium brasiliense* Endoglucanase (Accession No. AAM77701); *Chaetomium globosum* Endoglucanase (Accession No. EAQ86340); *Aspergillus fumigatus* Endoglucanase (Accession No. CAF31975); *Humicola insolens* Endoglucanase (Accession No. CAG27577); *Neosartorya fischeri* Endoglucanase (Accession No. XP_001267517); *Thielavia terrestris* Endoglucanase (Accession No. ACE10231); *Chrysosporium lucknowense* Endoglucanase (Accession No. ACH15008); *Chaetomium globosum* Endoglucanase (Accession No. XP_001226436); *Acremonium thermophilum* Endoglucanase (Accession No. ACE10216); *Humicola insolens* Endoglucanase (Accession No. CAB42307); *Thielavia terrestris* Endoglucanase (Accession No. CAH03187); *Chrysosporium lucknowense* Endoglucanase (Accession No. AAQ38151); *Magnaporthe grisea* Endoglucanase (Accession No. EDJ97375); *Chaetomium globosum* Endoglucanase (Accession No. EAQ84577); *Humicola insolens* Endoglucanase IDYS_B; *Neurospera crassa* Endoglucanase (Accession No. XP_957415); *Trichoderma reesei* Xyloglucanase (Accession No. AAP57752); *Aspergillus niger* Xyloglucanase (Accession No. AAK77227); *Aspergillus aculeatus* Xyloglucanase (Accession No. BAA29031); *Neosartorya fischeri* Xyloglucanase (Accession No. XP_001261776); *Chaetomium thermophilum* Endoxylanase (Accession No. CAD48749); *Trichoderma reesei* Endoxylanase (Accession No. ABK59833); *Chrysosporium lucknowense* Endoxylanase (Accession No. AAQ38147); *Aureobasidium pullulans* Endoxylanase (Accession No. BAE71410); *Aspergillus nidulans* beta-xylosidase (Accession No. CAA73902; *Cochliobolus carbonum* beta-xylosidase (Accession No. AAC67554); *Penicillium herquei* beta-xylosidase (Accession No. BAC75546); *Pyrenophora tritici-repentis* beta-xylosidase (Accession No. XP_001940956); *Aspergillus niger* beta-mannosidase (Accession No. Q9UUZ3); *Aspergillus aculeatus* beta-mannosidase (Accession No. BAA29029); *Neosartorya fischeri* beta-mannosidase (Accession No. XP_001258000); *Trichoderma reesei* alpha-glucuronidase (Accession No. CAA92949); *Aspergillus niger* alpha-glucuronidase (Accession No. CAC38119); *Talaromyces emersonii* alpha-glucuronidase (Accession No. AAL33576); *Aspergillus niger* acetylxylanesterase (Accession No. XP_001395572); *Trichoderma reesei* acetylxylanesterase (Accession No. Q99034); *Neosartorya fischeri* acetylxylanesterase (Accession No. XP_001262186); *Trichoderma reesei* arabinofuranosidase, 1,4-beta-D-arabinoxylan arabinofuranohydrolase (Accession No. AAP57750); *Chaetomium globosum* arabinofuranosidase, 1,4-beta-D-arabinoxylan arabinofuranohydrolase (Accession No. XP_001223478); *Aspergillus niger* arabinofuranosidase, 1,4-beta-D-arabinoxylan arabinofuranohydrolase (Accession No. XP_001389998); *Penicillium decumbens* Swollenin (Accession No. ACH57439); *Neosartorya fischeri* Swollenin (Accession No. XP_001257521); *Talaromyces stipitatus* Swollenin (Accession No EED19018); *Trichoderma reesei* (Accession No. AAP57751); *Chaetomium globosum* (Accession No. XP_001228455); *Magnaporthe grisea* (Accession No. XP_365869); *Trichoderma reesei* glucuronyl esterase (Accession No. AAP57749); *Chaetomium globosum* glucuronyl esterase (Accession No. XP 001226041); *Aspergillus fumigatus* glucuronyl esterase (Accession No. XP_751313); *Populus alba* alpha-expansin (Accession No. BAB39482); *Vitis lubrusca* alpha-expansin (Accession No. BAC66697); *Triticum aestivum* beta-expansin (Accession No. AAS48881); *Eucalyptus globulus* beta-expansin (Accession No. AAZ08315); *Aspergillus niger* Feruoyl esterase (Accession No. XP_001393337); *Aspergillus terreus* Feruoyl esterase (Accession No. XP_001211092); *Talaromyces stipitatus* Feruoyl esterase (Accession No. EED17739); *Chaetomium globosum* Feruoyl esterase (Accession No. XP_001228412) *Streptomyces avermitilis* 1,4-beta-cellobiosidase guxA1 (Accession No. NP_821732.1); *Streptomyces avermitilis* 1,4-beta-cellobiosidase guxA2 (Accession No. NP_823029.1); *Streptomyces avermitilis* 1,4-beta-cellobiosidase guxA3 (Accession No. NP_823031.1); *Streptomyces avermitilis* Endo-1,4-beta-glucanase celA1 (Accession No. NP_821730.1); *Streptomyces avermitilis* Endo-1,4-beta-glucanase celA2 (Accession No. NP_823030.1); *Streptomyces avermitilis* Endo-1,4-beta-glucanase celA3 (Accession No. NP_823032.1); *Streptomyces avermitilis* Endo-1,4-beta-glucanase celA4 (Accession No. NP_823744.1); *Streptomyces avermitilis* Endo-1,4-beta-glucanase (Accession No. NP_826394.1); *Streptomyces avermitilis* Endo-1,4-beta-glucanase celA5 (Accession No. NP_828072.1); *Streptomyces avermitilis* Beta-1,4-xylanase (Accession No. NP_823272.1); *Streptomyces avermitilis* Beta-1,4-xylanase (Accession No. NP_826161.1); *Streptomyces avermitilis* Xylanase (Accession No. NP_827548.1); *Streptomyces avermitilis* Endo-1,4-beta-xylanase xynD (Accession No. NP_827557.1); *Streptomyces avermitilis* 1,4-beta-xylosidase xynB1 (Accession No. NP_822628.1); *Streptomyces avermitilis* Beta-xylosidase (Accession No. NP_823285.1); *Streptomyces avermitilis* 1,4-beta-xylosidase xynB2 (Accession No. NP_826159.1); *Streptomyces avermitilis* 1,4-beta-xylosidase xynB3 (Accession No. NP_827745.1); *Streptomyces avermitilis* Beta-glucosidase bglC1 (Accession No. NP_822977.1); *Streptomyces avermitilis* Beta-glucosidase bglC2 (Accession No. NP_826430.1); *Streptomyces avermitilis* Beta-glucosidase bglC3 (Accession No. NP_826775.1); *Streptomyces avermitilis* AXE1 (Accession No. NP_822477.1); *Streptomyces avermitilis* AXE1 (Accession No. NP_822632.1); *Streptomyces avermitilis* abfA (Accession No. NP_822218.1); *Streptomyces avermitilis* abfB (Accession No. NP_822290.1); *Streptomyces avermitilis* abfA (Accession No. NP_826920.1); *Streptomyces avermitilis* abfB (Accession No. BAC74043.1); *Streptomyces avermitilis* SAV_6756 (Accession No. BAC74467.1); *Streptomyces avermitilis* agaA1 (Accession No. BAC68338.1); *Streptomyces avermitilis* agaA3 (Accession No. BAC68787.1); *Streptomyces avermitilis* agaB2 (Accession No. BAC69185.1); *Saccharophagus degradans* 2-40 Sde_2993 (Accession No. YP_528462.1); *Saccharophagus degradans* 2-40 Sdc_2996 (Accession No. YP_528465.1); *Saccharophagus degradans* 2-40 Sde_3023 (Accession No. YP_528492.1); *Saccharophagus degradans* 2-40 cel5A (Accession No. ABD82260.1); *Saccharophagus degradans* 2-40 cel5E (Accession No. ABD82186.1); *Saccharophagus degradans* 2-40 cel5F (Accession No. ABD80834.1); *Saccharophagus degradans* 2-40 cel5J (Accession No. ABD81754.1; *Saccharophagus degradans* 2-40 cel9A (Accession No. ABD79898.1); *Saccharophagus degradans* 2-40 ced3A (Accession No. ABD81757.1); *Saccharophagus degradans* 2-40 ced3B (Accession No. ABD79509.1); *Saccharophagus degradans* 2-40 bgl1A (Accession No. ABD82858.1); *Saccharophagus degradans* 2-40 bgl1B (Accession No. ABD80656.1); *Saccharophagus degradans* 2-40 Cep94A (Accession No. ABD80580.1); *Saccharophagus degradans* 2-40 Cep94B (Accession No. ABD80168.1); *Saccharophagus degradans* 2-40 Sde_0509 (Accession No. YP_525985.1); *Saccharophagus degradans* 2-40 Sde_0169 (Accession No. YP_525645.1); *Bacillus subtilis* Expansin exlX (Accession No. CAB13755.1); *Bacillus subtilis* Endo-1,4-beta-glucanase eglS (Accession No. CAB13696.2); *Bacillus subtilis* Endo-xylanase xynC (Accession No. CAB13698.1); *Bacillus subtilis* Endo-1,4-beta-xylanase xynD (Accession No. CAB13699.1); *Bacillus subtilis* Endo-1,4-beta-xylanase xynA (Accession No. CAB13776.1); *Bacillus subtilis* Xylan beta-1,4-xylosidase xynB (Accession No. CAB13642.2); *Clostridium phytofermentans* Cphy_3367 (Accession No. YP_001560459.1); *Clostridium phytofermentans* Cphy_3368 (Accession No. YP_001560460.1); *Clostridium phytofermentans* Cphy_2058 (Accession No. YP_001559165.1); *Clostridium phytofermentans* Cphy_3202 cellulase B (Accession No. YP_001560295.1); *Clostridium phytofermentans* Cphy_1163 (Accession No. YP_001558280.1); *Clostridium phytofermentans* Cphy_3329 (Accession No. YP_001560421.1); *Clostridium phytofermentans* Cphy_1125 (Accession No. YP_001558242.1); *Clostridium phytofermentans* Cphy_1510 (Accession No. YP_001558623.1); *Clostridium phytofermentans* Cphy_0624 (Accession No. YP_001557750.1); *Clostridium phytofermentans* Cphy_2105 XynA (Accession No. YP_001559210.1); *Clostridium phytofermentans* Cphy_2108 (Accession No. YP_001559213.1); *Clostridium phytofermentans* Cphy_3207 Y (Accession No. YP_001560300.1); *Clostridium phytofermentans* Cphy_0191 (Accession No. YP_001557317.1); *Clostridium phytofermentans* Cphy_0875 (Accession No. YP_001558000.1); *Clostridium phytofermentans* Cphy_1169 (Accession No. YP_001558286.1); *Clostridium phytofermentans* Cphy_1071 (Accession No. YP_001558190.1); *Clostridium phytofermentans* Cphy_2128 (Accession No. YP_001559233.1); *Clostridium phytofermentans* Cphy_2276 (Accession No. YP_001559376.1); *Clostridium phytofermentans* Cphy_1936 (Accession No. YP_001559043.1); *Clostridium cellulolyticum* cel5I (Accession No. AAL79562.1); *Clostridium cellulolyticum* CelCCF (dockerin) Cel48F-yeast CO template pMU914 (Accession No. AAB41452.1); *Clostridium cellulolyticum* Ccel_1259 (Accession No. YP_002505595); *Clostridium cellulolyticum* Ccel_2226 (Accession No. YP_002506548.1); *Clostridium cellulolyticum* Ccel_0732 (dockerin) Cel9E-yeast CO template pMU913 (Accession No. YP_002505091.1); *Clostridium cellulolyticum* Ccel_1099 (dockerin) Cel5A-yeast CO template pMU967 (Accession No. YP_002505438.1); *Clostridium cellulolyticum* Ccel_2392 (dockerin) (Accession No. YP_002506705.1); *Clostridium cellulolyticum* Ccel_0731 (dockerin) Cel9G-yeast CO template pMU892 (Accession No. YP_002505090.1); *Clostridium cellulolyticum* Ccel_0840 (dockerin) Cel5D-yeast CO template pMU891 (Accession No. YP_002505196.1); *Clostridium cellulolyticum* CelCCC (dockerin) Cel8C-yeast CO template pMU969 (Accession No. AAA73867.1); *Thermobifida fusca* endo-1,4-beta xylanase (Accession No. ABL73883.1); *Thermobifida fusca* endo-1,4-beta-D-xylanase (xyl11) (Accession No. AAV64879.1); *Thermobifida fusca* Endoglucanase (Accession No. AAZ55112.1); *Thermobifida fusca* cellulase (Accession No. AAZ56745.1); *Thermobifida fusca* exo-1,4-beta-glucosidase (Accession No. AAZ55642.1); *Thermobifida fusca* beta-glucosidase (Accession No. AAZ55664.1); *Thermobifida fusca* cellulose 1,4-beta-cellobiosidase (Accession No. YP_290015.1); *Thermobifida fusca* CBD E8 (Accession No. AAZ55700.1); *Thermobifida fusca* celC (E3) (Accession No. YP_288681.1); *Thermobifida fusca* celE (E5) (Accession No. YP_288962.1); *Thermobifida fusca* cel5B (Endoglucanase) (Accession No. AAP56348.1); *Thermobifida fusca* celA (E1) (Accession No. AAC06387.1); *Thermobifida fusca* celB (E2) (Accession No. YP_289135.1); *Thermobifida fusca* Tfu_1627 (1,4-beta-cellobiosidase) (Accession No. YP_289685.1); *Clostridium thermocellum* celA (dockerin) (Accession No. YP_001036701.1); *Clostridium thermocellum* celY (cel48Y) (Accession No. CAI06105.1); *Clostridium thermocellum* Cthe_0625 (dockerin) (Accession No. YP_001037053.1); *Clostridium thermocellum* celC (Accession No. CAC27410.1); *Clostridium thermocellum* (Accession No. YP_001037893.1); *Clostridium thermocel-*

*lum* (Accession No. YP_001038519.1); *Clostridium thermocellum* bglA (Accession No. CAA42814.1); *Clostridium thermocellum* bglB (Accession No. CAA33665.1); *Clostridium thermocellum* Cthe_2548 (Accession No. YP_001038942.1); *Clostridium thermocellum* Cthe_1273 (Accession No. YP_001037698.1); *Clostridium thermocellum* Cthe_0040 (Cel9I) (Accession No. YP_001036474.1); *Clostridium thermocellum* Cthe_0412 (dockerin) (Accession No. YP_001036843.1); *Clostridium thermocellum* Cthe_0825 (dockerin) (Accession No. YP_001037253.1); *Clostridium stercorarium* xynA (Accession No. CAD48307); *Clostridium stercorarium* xynB (CelW-celloxylanase) (Accession No. CAD48313); *Clostridium stercorarium* xynC (CelX-celloxylanase) (Accession No. CAD48314); *Clostridium stercorarium* bxlB (b-Xylosidase B) (Accession No. AJ508405); *Clostridium stercorarium* bxlA (b-Xylosidase A) (Accession No. AJ508404); *Clostridium stercorarium* bglZ (beta-glucosidase) (Accession No. CAB08072); *Clostridium stercorarium* arfA (alpha-arabinofuranosidaseA) (Accession No. AJ508406); *Clostridium stercorarium* arfB (alpha-arabinofuranosidaseB) (Accession No. AAC28125); *Clostridium stercorarium* celZ (Cs-Cel9Z-Avicellase I) (Accession No. CAA39010); *Clostridium stercorarium* celY (Cs-Cel48Y-Avicellase II) (Accession No. CAA93280); *Anaerocellum thermophilum* celA (1,4-beta-glucanase) (Accession No. CAB06786); *Anaerocellum thermophilum* celD (EG) (Accession No. CAB01405); *Anaerocellum thermophilum* xynA (1,4-beta-D-xylan xylanhydrolase) (Accession No. CAA93627); *Anaerocellum thermophilum* celB (EG5) (Accession No. Z86104); *Anaerocellum thermophilum* Athe_1866 (endo-1,4-beta-mannosidase) (Accession No. YP_002573059); *Anaerocellum thermophilum* Athe_0594 ("cellulase") (Accession No. YP_002572493).

In some embodiments, the cells of the invention can express pairs of enzymes that have synergistic activity with respect to their action on a given lignocellulosic substrate. Such pairs include, but are not limited to (*Streptomyces avermitilis* endo-1,4-beta-glucanase celA2 (Accession No. NP_823030.1) and *Streptomyces avermitilis* endo-1,4-beta-glucanase celA5 (Accession No. NP_828072.1)); (*Streptomyces avermitilis* endo-1,4-beta-glucanase celA2 (Accession No. NP_823030.1) and *Bacillus subtilis* endo-1,4-beta-glucanase (Accession No CAB13696.2)); (*Streptomyces avermitilis* endo-1,4-beta-glucanase celA3 (Accession No. NP_823032.1) and *Streptomyces avermitilis* endo-1,4-beta-glucanase (Accession No. NP_826394.1)); (*Streptomyces avermitilis* endo-1,4-beta-glucanase celA4 (Accession No. NP_823744.1) and *Streptomyces avermitilis* xylanase (Accession No. NP_827548.1)); (*Bacillus subtilis* endo-1,4-beta-glucanase (Accession No CAB13696.2) and *Streptomyces avermitilis* endo-1,4-beta-glucanase (Accession No. NP_826394.1)); (*Streptomyces avermitilis* endo-1,4-beta-glucanase celA4 (Accession No. NP_823744.1) and *Bacillus subtilis* endo-1,4-beta-glucanase (Accession No CAB13696.2)); (*Streptomyces avermitilis* endo-1,4-beta-glucanase celA5 (Accession No. NP_828072.1) and *Streptomyces avermitilis* endo-1,4-beta-glucanase celA4 (Accession No. NP_823744.1)); (*Streptomyces avermitilis* endo-1,4-beta-glucanase celA5 (Accession No. NP_828072.1) and *Clostridium phytofermentans* xylanase (Accession No. YP_001557750.1)); (*Saccharophagus degradans* 2-40 mannanase (Accession No. YP_525985.1) and *Streptomyces avermitilis* endo-1,4-beta-glucanase (Accession No. NP_826394.1)); (*Streptomyces avermitilis* xylanase (Accession No. NP_827548.1) and *Saccharophagus degradans* 2-40 mannanase (Accession No. YP_525985.1)); (*Clostridium phytofermentans* xylanase (Accession No. YP_001557750.1) and *Streptomyces avermitilis* xylanase (Accession No. NP_827548.1)); (*Clostridium phytofermentans* xylanase (Accession No. YP_001557750.1) and *Streptomyces avermitilis* xylanase (Accession No. NP_827548.1)); (*Streptomyces avermitilis* endo-1,4-beta-glucanase celA5 (Accession No. NP_828072.1) and *Streptomyces avermitilis* xylanase (Accession No. NP_827548.1)); (*Streptomyces avermitilis* endo-1,4-beta-glucanase (Accession No. NP_823744.1) and *Saccharophagus degradans* 2-40 mannanase (Accession No. YP_525985.1)); (*Streptomyces avermitilis* endo-1,4-beta-glucanase celA2 (Accession No. NP_823030.1) and *Saccharophagus degradans* 2-40 mannanase (Accession No. YP_525985.1)); (*Streptomyces avermitilis* endo-1,4-beta-glucanase (Accession No. NP_823744.1) and *Streptomyces avermitilis* endo-1,4-beta-glucanase celA3 (Accession No. NP_823032.1)); (*Streptomyces avermitilis* endo-1,4-beta-glucanase (Accession No. NP_823744.1) and *Clostridium phytofermentans* xylanase (Accession No. YP_001557750.1)); (*Streptomyces avermitilis* xylanase (Accession No. NP_827548.1) and *Streptomyces avermitilis* endo-1,4-beta-glucanase celA3 (Accession No. NP_823032.1)); (*Streptomyces avermitilis* endo-1,4-beta-glucanase celA4 (Accession No. NP_823744.1) and *Streptomyces avermitilis* endo-1,4-beta-glucanase (Accession No. NP_826394.1))

In some embodiments, host cells of the invention can express three enzymes that have synergistic activity with respect to their action on a given lignocellulosic substrate. Such triplets of enzymes can be, for example (*Streptomyces avermitilis* endo-1,4-beta-glucanase celA4 NP_823744.1. *Streptomyces avermitilis* endo-1,4-beta-glucanase celA5 NP_828072.1, and *Streptomyces avermitilis* endo-1,4-beta-glucanase celA2 NP_823030.1); (*Streptomyces avermitilis* xylanase NP_827548.1, *Streptomyces avermitilis* endo-1,4-beta-glucanase celA5 NP_828072.1, and *Streptomyces avermitilis* endo-1,4-beta-glucanase celA2 NP_823030.1); (*Clostridium phytofermentans* xylanase YP_001557750.1, *Streptomyces avermitilis* endo-1,4-beta-glucanase celA5 NP_828072.1, and *Streptomyces avermitilis* endo-1,4-beta-glucanase celA2 NP_823030.1); (*Saccharophagus degradans* 2-40 mannanase YP_525985.1. *Streptomyces avermitilis* endo-1,4-beta-glucanase celA5 NP_828072.1, and *Streptomyces avermitilis* endo-1,4-beta-glucanase celA2 NP_823030.1); (*Streptomyces avermitilis* endo-1,4-beta-glucanase celA3 NP_823032.1, *Streptomyces avermitilis* endo-1,4-beta-glucanase celA5 NP_828072.1, and *Streptomyces avermitilis* endo-1,4-beta-glucanase celA2 NP_823030.1); (*Bacillus subtilis* endo-1,4-beta-glucanase eglS CAB13696.2, *Streptomyces avermitilis* endo-1,4-beta-glucanase celA5 NP_828072.1, and *Streptomyces avermitilis* endo-1,4-beta-glucanase celA2 NP_823030.1); (*Streptomyces avermitilis* endo-1,4-beta-glucanase NP_826394.1, *Streptomyces avermitilis* endo-1,4-beta-glucanase celA5 NP_828072.1, and *Streptomyces avermitilis* endo-1,4-beta-glucanase celA2 NP_823030.1) (*Streptomyces avermitilis* endo-1,4-beta-glucanase celA2 NP_823030.1, *Streptomyces avermitilis* endo-1,4-beta-glucanase celA5 NP_828072.1, and *Streptomyces avermitilis* endo-1,4-beta-glucanase celA4 NP_823744.1); (*Streptomyces avermitilis* xylanase NP_827548.1 *Streptomyces avermitilis* endo-1,4-beta-glucanase celA5 NP_828072.1, and *Streptomyces avermitilis* endo-1,4-beta-glucanase celA4 NP_823744.1); (*Clostridium phytofermentans* xylanase YP_001557750.1, *Streptomyces avermitilis* endo-1,4-beta-glucanase celA5 NP_828072.1, and *Streptomyces avermitilis* endo-1,4-betaglucanase celA4 NP_823744.1); (*Saccharophagus degradans* 2-40 mannanase YP_525985.1, *Streptomyces avermitilis* endo-1,4-beta-glucanase celA5 NP_828072.1, and *Streptomyces avermitilis* endo-1,4-beta-glucanase celA4 NP_823744.1); (*Streptomyces avermitilis* endo-1,4-beta-glucanase celA3 NP_823032.1, *Streptomyces avermitilis* endo-1,4-beta-glucanase celA5 NP_828072.1, and *Streptomyces avermitilis* endo-1,4-beta-glucanase celA4 NP_823744.1); (*Streptomyces avermitilis* endo-1,4-beta-glucanase NP_826394.1, *Streptomyces avermitilis* endo-1,4-beta-glucanase celA5 NP_828072.1, and *Streptomyces avermitilis* endo-1,4-beta-glucanase celA4 NP_823744.1); (*Bacillus subtilis* endo-1,4-beta-glucanase eglS CAB13696.2, *Streptomyces avermitilis* endo-1,4-beta-glucanase celA5 NP_828072.1, and *Streptomyces avermitilis* endo-1,4-beta-glucanase celA4 NP_823744.1); (*Streptomyces avermitilis* endo-1,4-beta-glucanase celA2 NP_823030.1, *Streptomyces avermitilis* endo-1,4-beta-glucanase celA5 NP_828072.1, and *Streptomyces avermitilis* xylanase NP_827548.1); (*Streptomyces avermitilis* endo-1,4-beta-glucanase celA4 NP_823744.1, *Streptomyces avermitilis* endo-1,4-beta-glucanase celA5 NP_828072.1, and *Streptomyces avermitilis* xylanase NP_827548.1); (*Clostridium phytofermentans* xylanase YP_001557750.1, *Streptomyces avermitilis* endo-1,4-beta-glucanase celA5 NP_828072.1, and *Streptomyces avermitilis* xylanase NP_827548.1); (*Saccharophagus degradans* 2-40 mannanase YP_525985.1, *Streptomyces avermitilis* endo-1,4-beta-glucanase celA5 NP_828072.1, and *Streptomyces avermitilis* xylanase NP_827548.1); (*Streptomyces avermitilis* endo-1,4-beta-glucanase celA3 NP_823032.1, *Streptomyces avermitilis* endo-1,4-beta-glucanase celA5 NP_828072.1, and *Streptomyces avermitilis* xylanase NP_827548.1); (*Streptomyces avermitilis* endo-1,4-beta-glucanase NP_826394.1, *Streptomyces avermitilis* endo-1,4-beta-glucanase celA5 NP_828072.1, and *Streptomyces avermitilis* xylanase NP_827548.1); (*Bacillus subtilis* endo-1,4-beta-glucanase eglS CAB13696.2, *Streptomyces avermitilis* endo-1,4-beta-glucanase celA5 NP_828072.1, and *Streptomyces avermitilis* xylanase NP_827548.1); (*Streptomyces avermitilis* endo-1,4-beta-glucanase celA2 NP_823030.1, *Streptomyces avermitilis* endo-1,4-beta-glucanase celA5 NP_828072.1, and *Clostridium phytofermentans* xylanase YP_001557750.1); (*Streptomyces avermitilis* endo-1,4-beta-glucanase celA4 NP_823744.1, *Streptomyces avermitilis* endo-1,4-beta-glucanase celA5 NP_828072.1, and *Clostridium phytofermentans* xylanase YP_001557750.1); (*Streptomyces avermitilis* xylanase NP_827548.1, *Streptomyces avermitilis* endo-1,4-beta-glucanase celA5 NP_828072.1, and *Clostridium phytofermentans* xylanase YP_001557750.1); (*Saccharophagus degradans* 2-40 mannanase YP_525985.1. *Streptomyces avermitilis* endo-1,4-beta-glucanase celA5 NP_828072.1, and *Clostridium phytofermentans* xylanase YP_001557750.1); (*Streptomyces avermitilis* endo-1,4-beta-glucanase celA3 NP_823032.1, *Streptomyces avermitilis* endo-1,4-beta-glucanase celA5 NP_828072.1, and *Clostridium phytofermentans* xylanase YP_001557750.1); (*Streptomyces avermitilis* endo-1,4-beta-glucanase NP_826394.1, *Streptomyces avermitilis* endo-1,4-beta-glucanase celA5 NP_828072.1, and *Clostridium phytofermentans* xylanase YP_001557750.1); and, (*Bacillus subtilis* endo-1,4-beta-glucanase eglS CAB13696.2, *Streptomyces avermitilis* endo-1,4-beta-glucanase celA5 NP_828072.1, and *Clostridium phytofermentans* xylanase YP_001557750.1)

In some embodiments, host cells of the invention can express four enzymes that have synergistic activity with respect to their action on a given lignocellulosic substrate. Such quadruplets of enzymes can be, for example (*Streptomyces avermitilis* endo-1,4-beta-glucanase celA4 NP_823744.1, *Streptomyces avermitilis* xylanase NP_827548.1, *Streptomyces avermitilis* endo-1,4-beta-glucanase celA5 NP_828072.1, and *Streptomyces avermitilis* endo-1,4-beta-glucanase celA2 NP_823030.1); (*Clostridium phytofermentans* xylanase YP_001557750.1, *Streptomyces avermitilis* xylanase NP_827548.1, *Streptomyces avermitilis* endo-1,4-beta-glucanase celA5 NP_828072.1, and *Streptomyces avermitilis* endo-1,4-beta-glucanase celA2 NP_823030.1); (*Clostridium phytofermentans* xylanase YP_001557750.1. *Streptomyces avermitilis* endo-1,4-beta-glucanase celA4 NP_823744.1, *Streptomyces avermitilis* endo-1,4-beta-glucanase celA5 NP_828072.1, and *Streptomyces avermitilis* endo-1,4-beta-glucanase celA2 NP_823030.1); (*Streptomyces avermitilis* endo-1,4-beta-glucanase NP_826394.1, *Streptomyces avermitilis* endo-1,4-beta-glucanase celA4 NP_823744.1, *Streptomyces avermitilis* endo-1,4-beta-glucanase celA5 NP_828072.1, and *Streptomyces avermitilis* endo-1,4-beta-glucanase celA2 NP_823030.1); (*Saccharophagus degradans* 2-40 mannanase YP_525985.1, *Streptomyces avermitilis* xylanase NP_827548.1, *Streptomyces avermitilis* endo-1,4-beta-glucanase celA5 NP_828072.1, and *Streptomyces avermitilis* endo-1,4-beta-glucanase celA2 NP_823030.1); and, (*Saccharophagus degradans* 2-40 mannanase YP_525985.1, *Streptomyces avermitilis* endo-1,4-beta-glucanase celA4, NP_823744.1, *Streptomyces avermitilis* endo-1,4-beta-glucanase celA5 NP_828072.1, and *Streptomyces avermitilis* endo-1,4-beta-glucanase celA2 NP_823030.1)

In some embodiments, the yeast cell expresses any one or more of the above-named genes in conjunction with one or more CBH1, CBH2, EG, or BGL.

In some embodiments, the cells of the invention can be used to reduce the amount of external enzyme needed to hydrolyze lignocellulose during an SSF or CBP process, or to increase the yield of a fermentation product during SSF or CBP at a given cellulase loading.

In some embodiments, the invention provides polynucleotide and amino acid sequences of endoglucanases, xylanases, xylosidases, esterases, other hydrolases, and other accessory enzymes that are active and well-expressed by *S. cerevisiae* and other yeast species. In some embodiments, these well-expressed enzymes provide an increased ability of cellulase cocktails to hydrolyze lignocellulose. In some embodiments, combinations of the enzymes of the present invention are useful for increasing the activity of yeast expressed "core" cellulases, CBH1, CBH2, EG, and BGL. In some embodiments, the host yeast cell expresses, in addition to the "core" cellulases, xylanase, xylosidase, glucoamylase, and acetixylan esterase. In some embodiments, the invention provides technology for expressing multiple genes in multiple copies using yeast high-expression vectors, centromeric vectors and by genomic integration.

In some embodiments, the present invention relates to processes of producing fermentation products by contacting cells of the invention with lignocellulosic material and then recovering the fermentation material.

In some embodiments, the invention relates to the products produced by the fermentation of lignocellulosic materials.

In one aspect, the saccharolytic enzymes (amylases, cellulases, hemicellulases, cellulolytic and amylolytic accessory enzymes, inulinases, levanases, and others) and pentose utilizing enzymes are combined in a single yeast strain. In another embodiment, the hydrolytic and pentose hydrolyzing enzymes are expressed in different yeast strains used in the same technological process. In one aspect, yeast strains, each expressing a different enzyme, or a different combination of enzymes, are co-cultured in the same volume. In another embodiment, yeast strains, each expressing a different enzyme, or a different combination of enzymes, are cultured in separate tanks.

Complex biomass feedstocks contain varying amounts of starch, lignocellulosic material, and pentose sugars. Accordingly, the yeast strains of the present invention are constructed to express different saccharolytic enzymes at different levels. In one embodiment, a yeast strain expresses one or more cellulolytic enzymes at a higher level than one or more amylolytic enzymes and one or more pentose sugar utilizing enzymes. In another embodiment, the yeast strain expresses one or more amylolytic enzymes at a higher level than one or more cellulolytic enzymes and one or more pentose sugar utilizing enzymes. In yet another embodiment, the yeast strain expresses one or more pentose sugar utilizing enzymes at a higher level than one or more cellulolytic enzymes and one or more amylolytic enzymes.

In some embodiments, the present invention relates to a recombinant yeast host cell comprising a heterologous polynucleotide encoding a polypeptide comprising an amino acid sequence at least 90% identical to any one of the amino acid sequences of SEQ ID NOs: 442-446.

In some embodiments, the present invention relates to a recombinant yeast host cell comprising one or more heterologous polynucleotides encoding a polypeptide of Table 19.

In some embodiments, the present invention relates to a recombinant yeast host cell comprising: (a) at least one heterologous polynucleotide comprising a nucleic acid which encodes a glucoamylase: (b) at least one heterologous polynucleotide comprising a nucleic acid which encodes an alpha-glucosidase: (c) at least one heterologous polynucleotide comprising a nucleic acid which encodes an enzyme that utilizes pentose sugar; and (d) further comprising at least one heterologous polynucleotide encoding a polypeptide comprising an amino acid sequence according to SEQ ID NOs: 442-446. In another embodiment, the yeast host cell further comprises an alpha-amylase, a pullulanase, and/or an isopullulanse.

In some embodiments, the cells of the invention can express pairs of amylolytic enzymes that have synergistic activity with respect to their action on a given biomass substrate. Such pairs include, but are not limited to (SEQ ID NO: 443 and SEQ ID NO: 444); (SEQ ID NO: 443 and SEQ ID NO: 445); (SEQ ID NO: 445 and SEQ ID NO: 446); (SEQ ID NO: 443 and SEQ ID NO: 445); (SEQ ID NO: 442 and SEQ ID NO: 445); (SEQ ID NO: 444 and *Bacillus subtilis* arabinoxylanase (Accession No. CAB13699.1)); (SEQ ID NO: 444 and *Bacillus subtilis* arabinan endo-1,5-alpha-L-arabinosidase (Accession No. CAB15969.1)); (SEQ ID NO: 444 and *Bacillus subtilis* arabinan-endo 1,5-alpha-L-arabinase (Accession No. CAA99586.1)); (SEQ ID NO: 444 and *Bacillus subtilis* arabinan endo-1,5-alpha-L-arabinosidase (Accession No. AL009126)); (SEQ ID NO: 444 and *Bacillus subtilis* endo-arabinase (Accession No. D85132)); (SEQ ID NO: 444 and *Clostridium phytofermentans* arabinogalactan endo-1,4-beta-galactosidase (Accession No. CP000885)); (SEQ ID NO: 444 and *Bacillus licheniformis* arabinan-endo 1,5-alpha-L-arabinase (Accession No. AAU40201.1); (SEQ ID NO: 444 and *Bacillus licheniformis* arabinan-endo 1,5-alpha-L-arabinase (Accession No. AAU41895.1); (SEQ ID NO: 444 and *Bacillus licheniformis* arabinogalactan endo-1,4-beta-galactosidase (Accession No. AAU43089.1); (SEQ ID NO: 444 and *Bacillus licheniformis* arabinan endo-1,5-alpha-L-arabinosidase (Accession No. AAU43033.1); (SEQ ID NO:

444 and *Bacillus licheniformis* arabinan endo-1,4-beta-xylanase (Accession No. AAU39947.1); (SEQ ID NO: 444 and *Thermoanaerobacterium saccharolyticum* arabinogalactan endo-1,4-beta-galactosidase); (SEQ ID NO: 444 and *Thermoanaerobacterium saccharolyticum* alpha-N-arabinofuranosidase); (SEQ ID NO: 444 and *Streptomyces avermitilis* endo-1,4-beta-xylanase xynD (Accession No. 827557.1); (SEQ ID NO: 444 and *Bacillus subtilis* endo-1,4-beta-xylanase xynA (Accession No. CAB13776.1); (SEQ ID NO: 444 and *Clostridium phytofermentans* xylanase (Accession No. YP_001558623.1); (SEQ ID NO: 444 and *Clostridium phytofermentans* xylanase (Accession No. YP_001557750.1); (SEQ ID NO: 444 and *Thermobifida fusca* endo-1,4-beta-D-xylanase (xyl11) (Accession No. AAV64879.1); (SEQ ID NO: 444 and *Clostridium thermocellum* xylanase (Accession No. YP_001038519.1); (SEQ ID NO: 444 and *Clostridium stercorarium* endo-xylanase (Accession No. CAD48307); (SEQ ID NO: 444 and *Clostridium stercorarium* xynC (CelX-celloxylanase) (Accession No. CAD48314); (SEQ ID NO: 444 and *Aspergillus niger* alpha-glucosidase (Accession No. BAA23616.1)); (SEQ ID NO: 444 and *Thermoanaerobacterium saccharolyticum* glucoamylase).

In some embodiments, host cells of the invention can express three enzymes that have synergistic activity with respect to their action on a given biomass substrate. Such triplets of enzymes can be, for example (SEQ ID NO: 442, SEQ ID NO: 445 and SEQ ID NO: 446); (SEQ ID NO: 444, SEQ ID NO: 445 and SEQ ID NO: 446); (SEQ ID NO: 442, SEQ ID NO: 445 and SEQ ID NO: 446).

In some embodiments, host cells of the invention can express four enzymes that have synergistic activity with respect to their action on a given biomass substrate. Such quadruplets of enzymes can be, for example (SEQ ID NO: 442, SEQ ID NO: 444, SEQ ID NO: 445 and SEQ ID NO: 446); (SEQ ID NO: 443, SEQ ID NO: 444, SEQ ID NO: 445 and SEQ ID NO: 446).

In some embodiments, the present invention relates to a method of producing a fermentation product comprising: (a) combining a yeast cell of any one of claims 1-34 with grain feedstock; (b) allowing the yeast cell to ferment the grain feedstock; and (c) recovering one or more products of the fermentation.

In some embodiments, the present invention relates to a recombinant yeast host cell comprising two or more heterologous polynucleotides encoding a polypeptide comprising: (a) at least one amino acid sequences at least 90% identical to one or more of the amino acid sequences of SEQ ID NOs: 219-436; and (b) at least one amino acid sequences at least 90% identical to one or more of the amino acid sequences of SEQ ID NOs: 442-446.

In some embodiments, the present invention relates to a recombinant yeast host cell comprising: (a) at least one heterologous polynucleotide encoding a polypeptide of Table 11; and (b) at least one heterologous polynucleotide encoding a polypeptide of Table 19.

Standard dose (0.45 AGU/g TS) of commercial glucoamylase (Speezyme, Genencor Inc.) was added to the control strain M0139. All other strains were fermented without any exogenous enzymes added.

Figure 54:
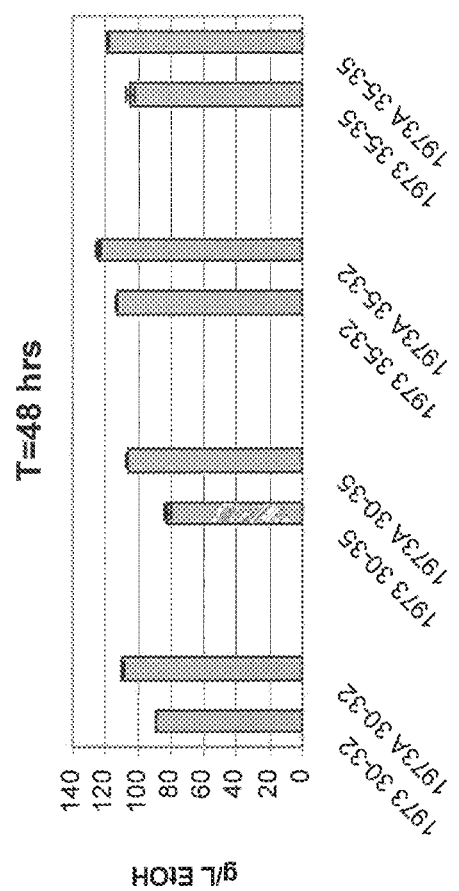

FIG. 54 depicts the adaptation of amylolytic M1973 strain by serial transfer. 1973—Original M1973 strain from freezer stock; 1973A—Adopted M1973 strain. The strains were evaluated by fermentation on 30% or 35% TS corn mash (first number) at 32° C. or 35° C. (second number). Data shown for 48 h time point.

Figure 55:
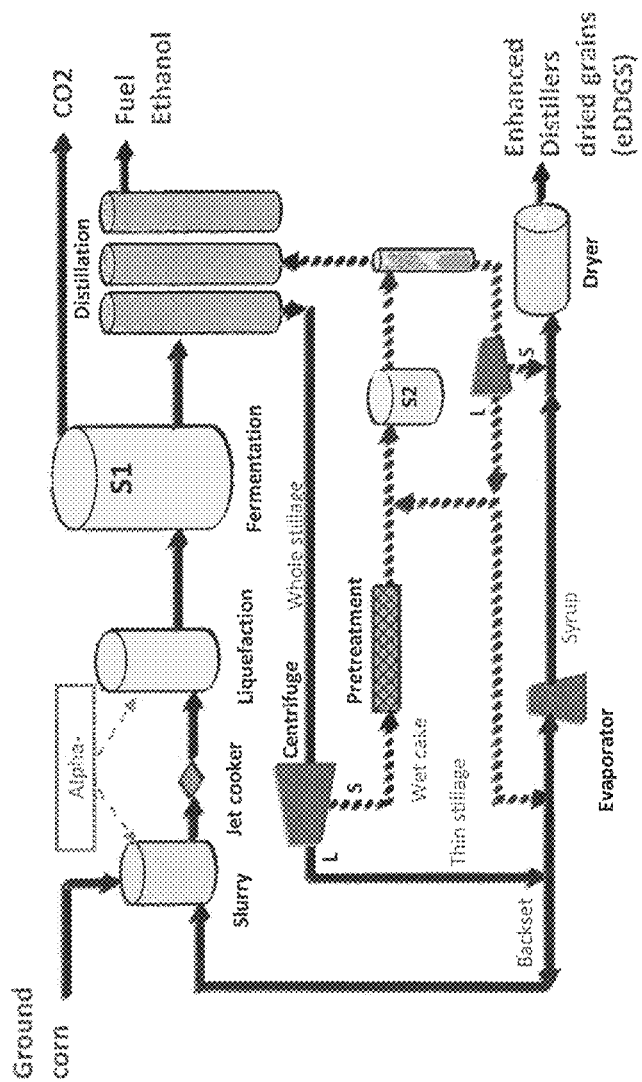

FIG. 55 depicts an example of a process flow sheet with CBP yeast strains. Ground corn mash is used as a substrate. Two yeast CBP strains are used in the process and cultured separately, S1 and S2. Liquefied corn pre-treated with alpha-amylases is fermented by yeast strain S1. S1 has an optimal set of amylases and accessory enzymes engineered to efficiently convert starch into glucose without any exogenous enzymes added. After distillation the stillage is being pre-treated and fermented by strain S2. S2 has a cellulolytic set of enzymes engineered and optimized for corn fiber conversion as well as xylose and arabinose pathways.

Figure 56:
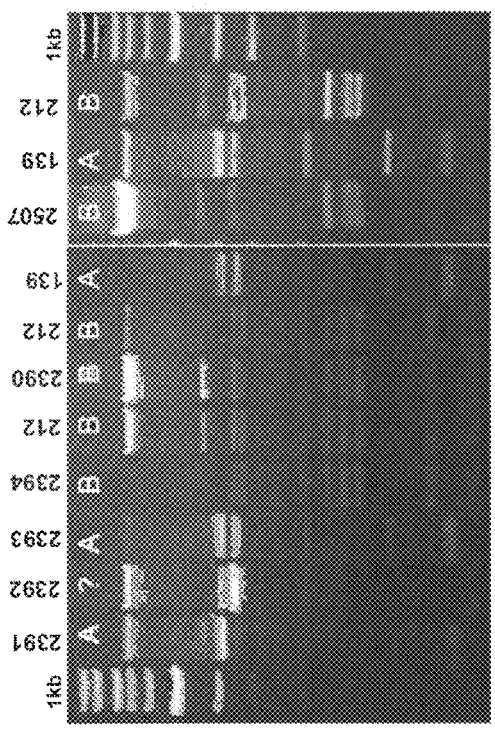

FIG. 56 depicts PCR genotyping of industrial yeast strains genomic DNA (Ness et al. 1993). 1 kb—NEB 1 kb ladder. A—M0139 like pattern; B—M2390 like pattern.

Figure 57:
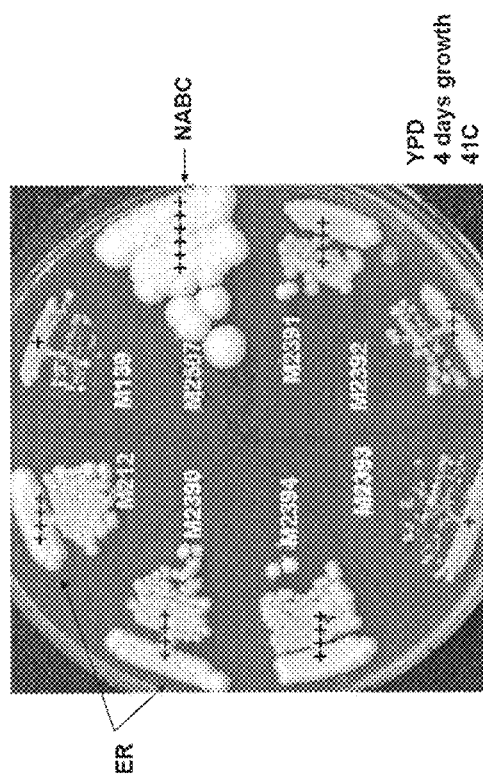

FIG. 57 depicts growth of industrial yeast strains at 41° C. Strains were streaked for singles on YPD plate and incubated at 41° C. for 4 days.

Figure 58:
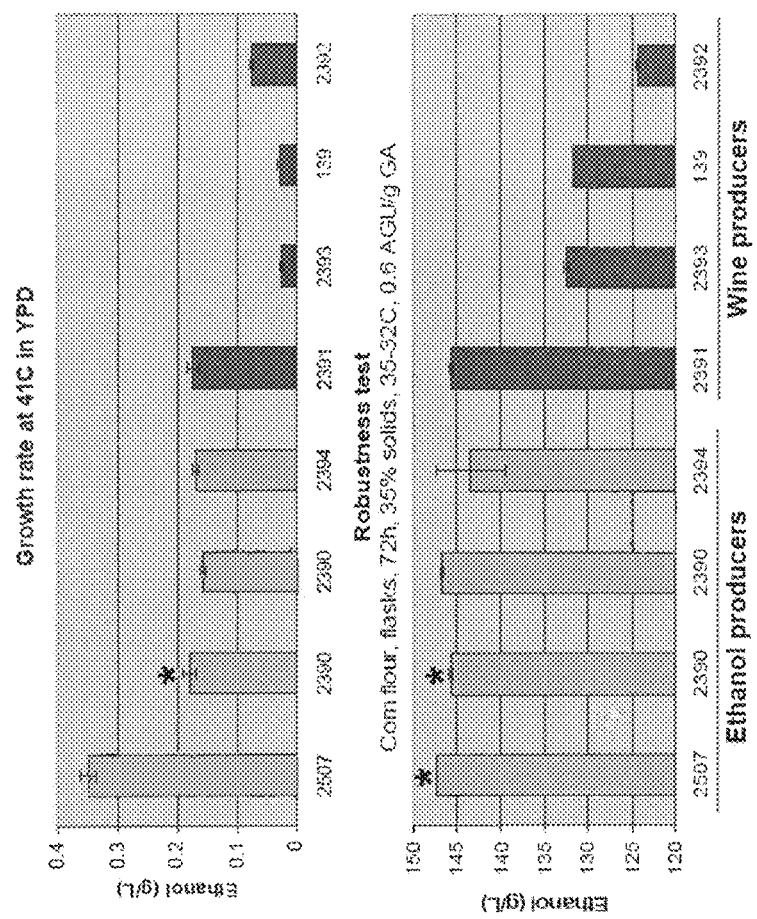

FIG. 58 (Top) depicts maximum growth rate at 41° C. in YPD of industrial strains described in Table 20. Growth rate measured by plate reader Synergy 2 (BioTek) following manufacture's instructions. Bottom—Corn flour fermentation in shake flasks at 72 h of industrial strains described in Table 20. Raw corn flour was used as substrate. Fermentation was performed at 35% of total solids; at the temperature of 35° C. for 24 h followed by 32° C. for the rest of fermentation. Strains marked with "*" were done in separate experiment at similar conditions but at 33% of total solids. Full commercial dose of exogenous GA was added to all strains at concentration 0.6 AGU/g of total solids. Experiment was done in duplicates. Commercial enzyme Spirizyme Ultra (Novozymes) was used as exogenous glucoamylase. Ethanol was measured by HPLC.

Figure 59:
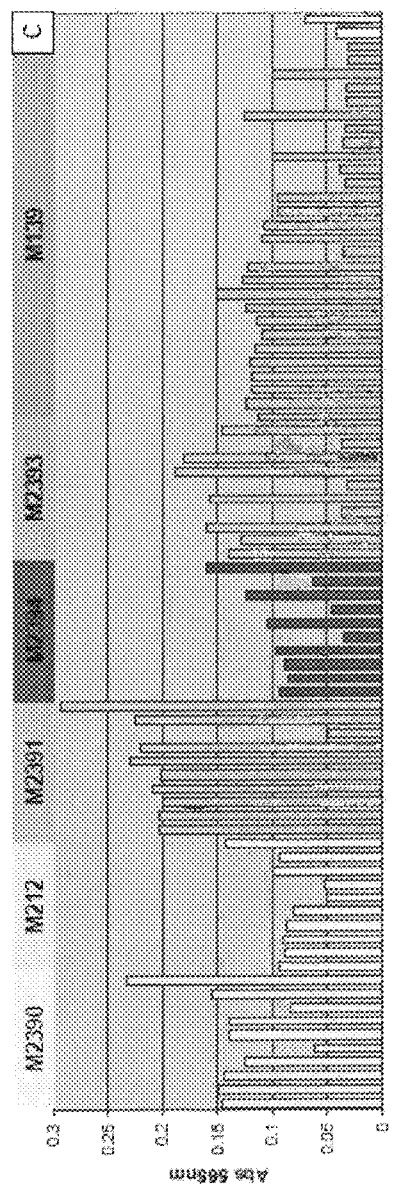

FIG. 59 depicts a map of expression construct used to transform different industrial hosts. ENO1—*S. cerevisiae* ENO1 promoter; AE9 CO—codon optimized for *S. cerevisiae Saccharomycopsis fibuligera* glucoamylase gene (NCBI#CAC83969.1); S.cer ENO1 ter—*S. cerevisiae* ENO1 terminator; PDC1—*S. cerevisiae* PDC1 terminator; ADH1—*S. cerevisiae* ADH1 promoter, TEF—*S. cerevisiae* TEF2 promoter; nat1—*Streptomyces noursei* nat1 genes that confers resistance to antibiotic Nourseothricin; TR11—*S. cerevisiae* TRI1 terminator. DNA fragments were PCRed separately and recombined in vivo during yeast transformation.

Figure 60:
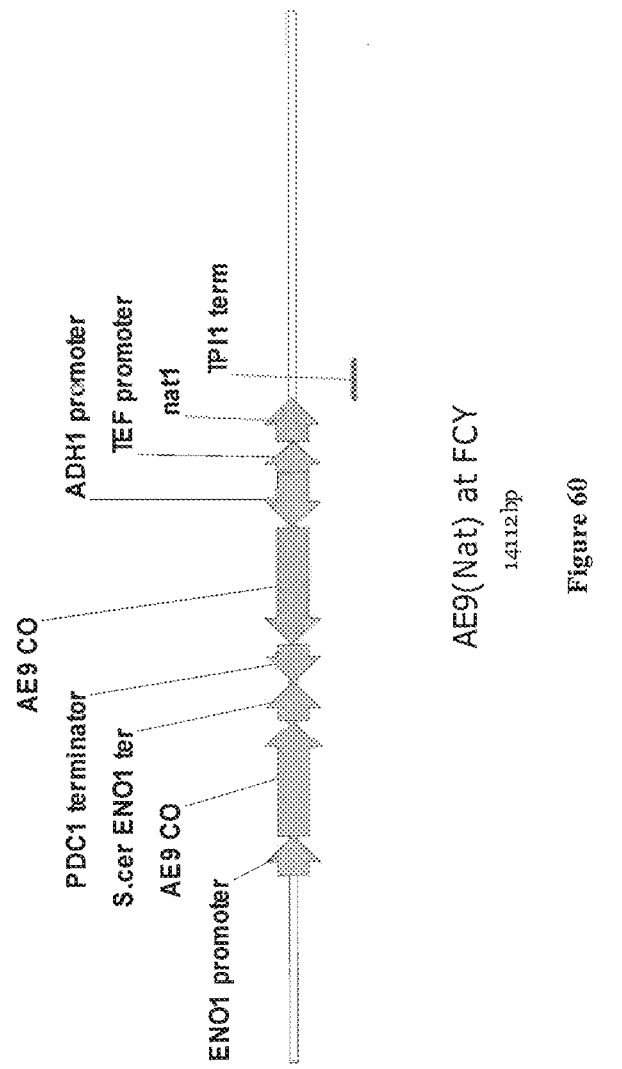

FIG. 60 depicts secreted amylolytic activity of industrial strains (Table 20) transformed with 4 copies of *Saccharomycopsis fibuligera* glucoamylase gene (NCBI#CAC83969.1). Top panel shows the names of host strains. Activity was measured by Starch assay. Several transformants were picked for each host. Supernatant of untransformed M0139 strain was used as negative control (C).

Figure 61:
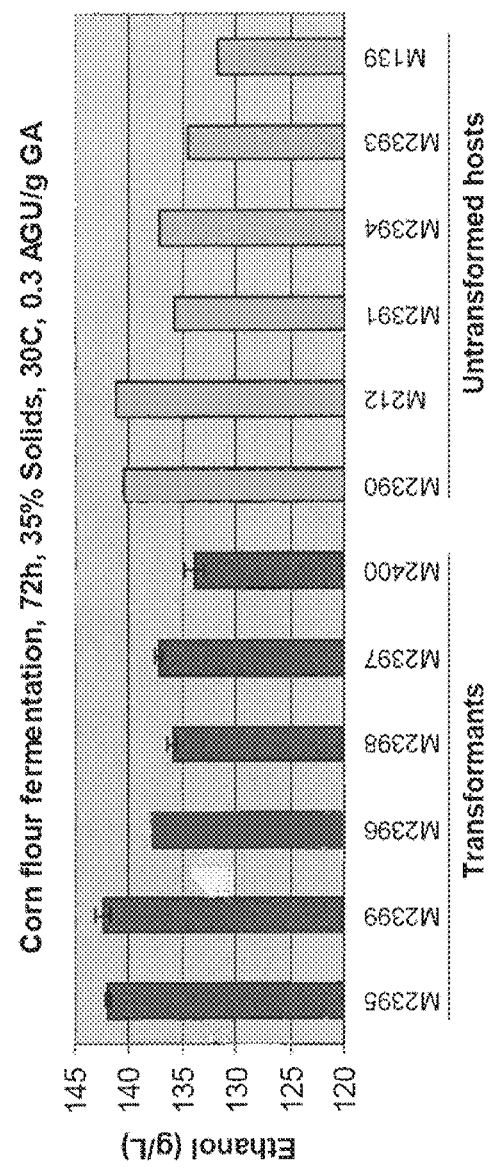

FIG. 61 depicts corn flour fermentation in shake flasks at 72 h of industrial strains and their transformants engineered to express 4 copies of *Saccharomycopsis fibuligera* glucoamylase gene (NCBI#CAC83969.1). Raw corn flour was used as a substrate. The strains are described in the tables 20 and 22. Fermentation was performed at 35% of total solids; at the temperature of 35 C. for 24 h followed by 32° C. for the rest of fermentation. Exogenous GA was added to all strains at concentration 0.3 AGU/g of solids. Transformed strains were done in duplicates. Host strains were done in singles. Commercial enzyme Spirizyme Ultra (Novozymes) was used as exogenous glucoamylase. Ethanol was measured by HPLC.

Figure 62:
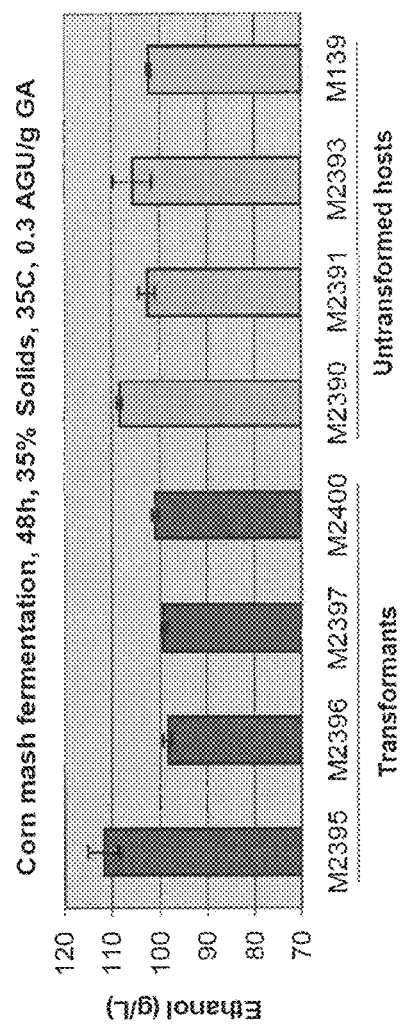

FIG. 62 depicts corn mash fermentation in shake flasks at 48 h of industrial strains and their transformants engineered to express 4 copies of *Saccharomycopsis fibuligera* glucoamylase gene (NCBI#CAC83969.1). Liquefied corn pretreated with alpha-amylases from conventional plant was used as substrate. The strains are described in the tables 20 and 22. Fermentation was performed at 35% of total solids and 35° C. Exogenous GA was added to all strains at concentration 0.3 AGU/g of solids. The experiment was done in duplicates. Commercial enzyme Spirizyme Ultra (Novozymes) was used as exogenous glucoamylase. Ethanol was measured by HPLC.

Figure 63:
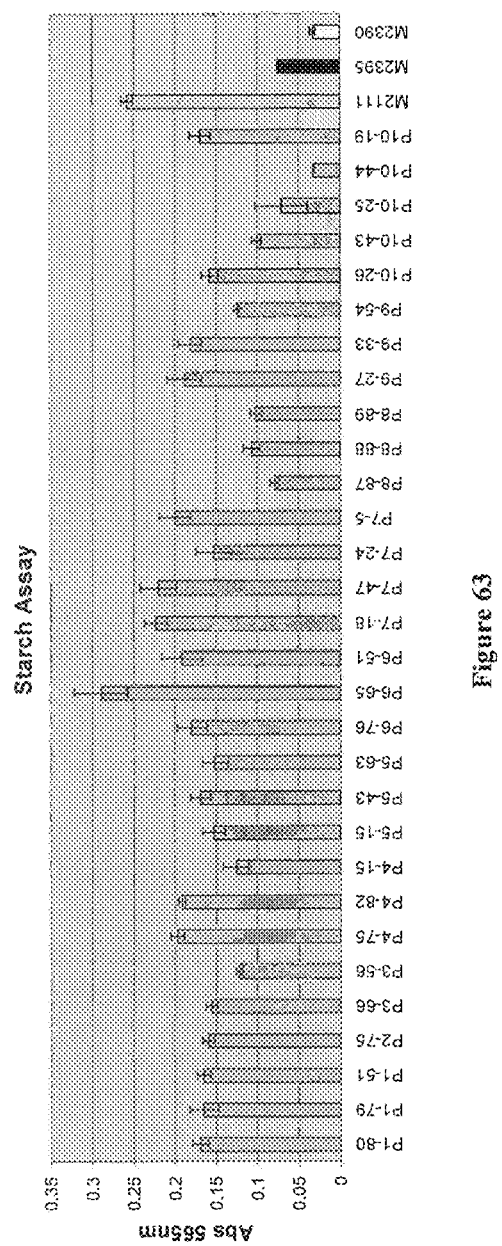

FIG. 63 depicts secreted amylolytic activity of M2390 transformants engineered to express 4 copies of AE9—*Saccharomycopsis fibuligera* glucoamylase gene (NCBI#CAC83969.1). About 1000 transformants were screened by Starch assay. This experiment shows repeated Starch assay data for 30 the most active transformants. Experiment was done in triplicates. Supernatant of untransformed M2390 strain was used as negative control. Strains M2111 and M2395 were used as positive control (see Tables 20 and 21 for strains description).

Figure 64:
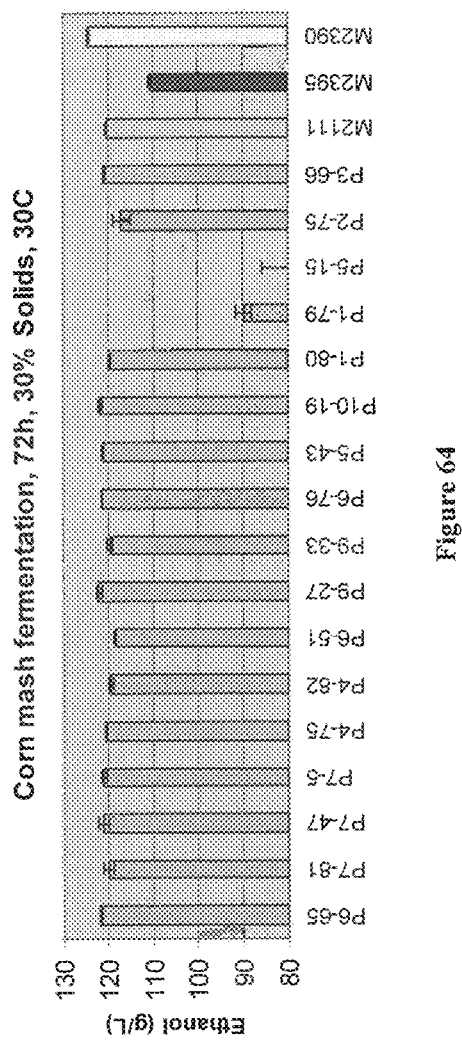

FIG. 64 depicts corn mash fermentation in minivials at 72 h of M2390 transformants engineered to express 4 copies of AE9—*Saccharomycopsis fibuligera* glucoamylase gene (NCBI#CAC83969.1). Seventeen best transformants from amylolytic activity screen (FIG. 63) were selected for this experiment. Fermentation was performed at 30% of total solids and 30° C. Exogenous GA was added to the untransformed M2390 strain only, at concentration 0.3 AGU/g of solids. The experiment was done in duplicates. M2111, M2395 and M2390 strains were used as controls (see tables 20 and 21 for strains description). Commercial enzyme Spirizyme Ultra (Novozymes) was used as exogenous glucoamylase. Ethanol was measured by HPLC.

Figure 65:
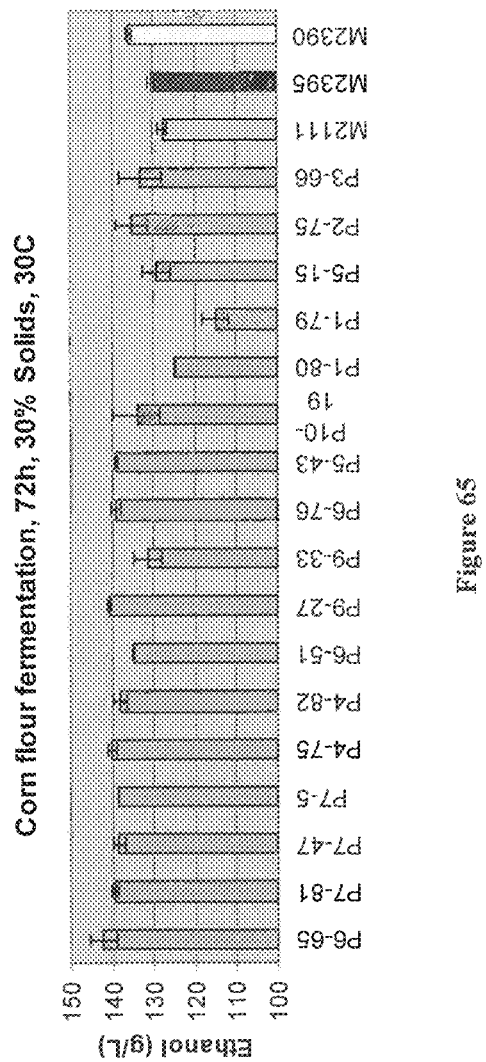

FIG. 65 depicts corn flour fermentation in minivials at 72 h of M2390 transformants engineered to express 4 copies of AE9—*Saccharomycopsis fibuligera* glucoamylase gene (NCBI#CAC83969.1). Seventeen best transformants from amylolytic activity screen (FIG. 63) were selected for this experiment. Fermentation was performed at 30% of total solids and 30° C. Exogenous GA was added to the untransformed M2390 strain at concentration 0.3 AGU/g of solids and at 0.1 AGU/g to all other strains. The experiment was done in duplicates. M2111, M2395 and M2390 strains were used as controls (see Tables 20 and 21 for strains description). Commercial enzyme Spirizyme Ultra (Novozymes) was used as exogenous glucoamylase. Ethanol was measured by HPLC.

Figure 66:
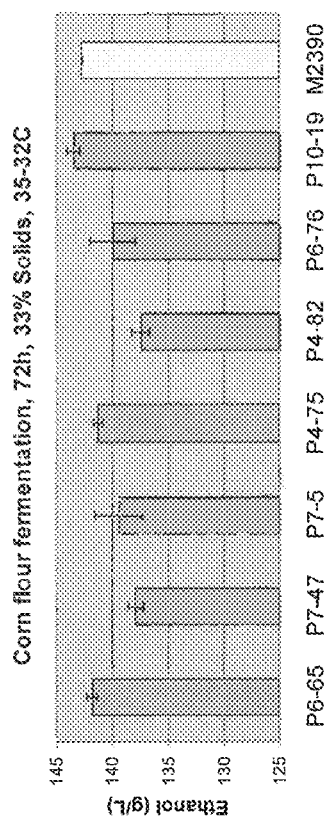

FIG. 66 depicts corn flour fermentation in shake flasks at 72 h of M2390 transformants engineered to express 4 copies of AE9—*Saccharomycopsis fibuligera* glucoamylase gene (NCBI#CAC83969.1). Seven best transformants from minivials fermentation screen (FIGS. 64-65) were selected for this experiment. Fermentation was performed at 33% of total solids at the temperature of 35° C. for 24 h followed by 32° C. for the rest of fermentation. Exogenous GA was added to the untransformed M2390 strain at concentration 0.6 AGU/g of solids and at 0.1 AGU/g to all other strains. The experiment was done in duplicates. Commercial enzyme Spirizyme Ultra (Novozymes) was used as exogenous glucoamylase. Ethanol was measured by HPLC.

Figure 67:
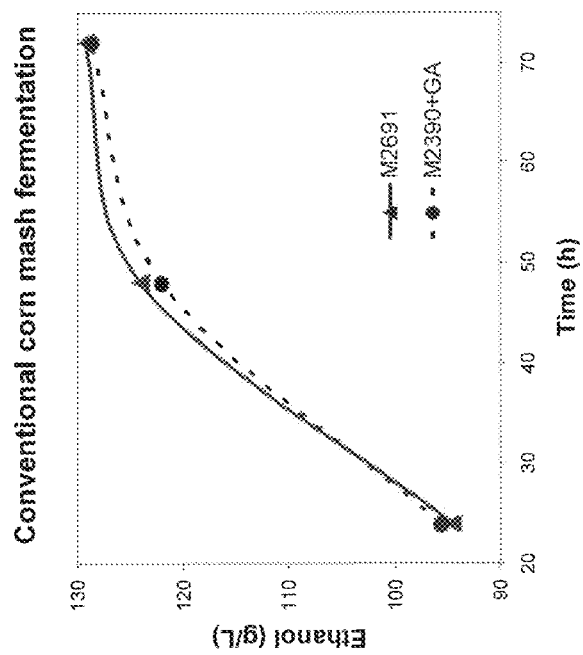

FIG. 67 depicts time course of liquefied conventional corn mash fermentation in shake flasks of M2691 strain—the best M2390 transformant engineered to express 4 copies of AE9—*Saccharomycopsis fibuligera* glucoamylase gene (NCBI#CAC83969.1). Transformant P10-19 (FIG. 66) was re-named as M2691. Fermentation was performed at 32.5% of total solids at the temperature of 35° C. for 24 h followed by 32° C. for the rest of fermentation. Exogenous GA was added to the untransformed M2390 strain only, at concentration 0.3 AGU/g of solids. The experiment was done in duplicates. Commercial enzyme Spirizyme Ultra (Novozymes) was used as exogenous glucoamylase. Ethanol was measured by HPLC.

Figure 68:
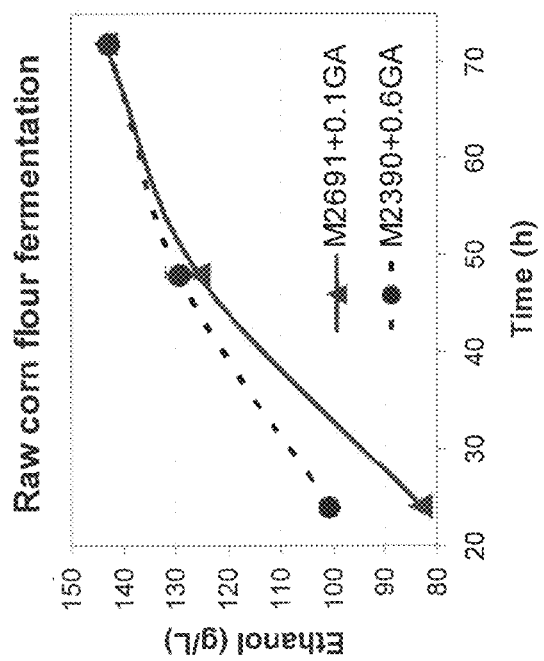

FIG. 68 depicts time course of raw corn flour fermentation in shake flasks of M2691 strain—the best M2390 transformant engineered to express 4 copies of AE9—*Saccharomycopsis fibuligera* glucoamylase gene (NCBI#CAC83969.1). Transformant P10-19 (FIG. 66) was re-named as M2691. Fermentation was performed at 33% of total solids at the temperature of 35° C. for 24 h followed by 32° C. for the rest of fermentation. Exogenous GA was added to the untransformed M2390 strain at concentration 0.6 AGU/g of solids and at 0.1 AGU/g to M2691. The experiment was done in duplicates. Commercial enzyme Spirizyme Ultra (Novozymes) was used as exogenous glucoamylase. Ethanol was measured by HPLC.

Figure 69:
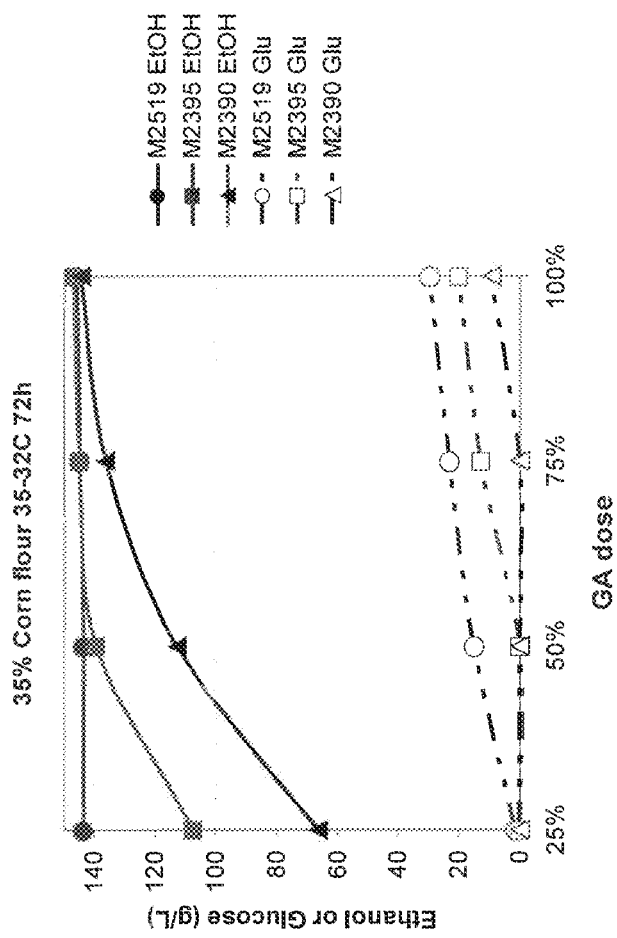

FIG. 69 depicts exogenous glucoamylase dose response for untransformed M2390 strain, low GA producer M2395 strain, and high GA producer M2519 (P6-65). Corn flour shake flasks fermentation was performed at 35% of total solids at the temperature of 35° C. for 24 h followed by 32° C. for the rest of fermentation. The experiment was done in duplicates. Commercial enzyme Spirizyme Ultra (Novozymes) was used as exogenous glucoamylase. Ethanol and glucose were measured by HPLC.

Figure 70:
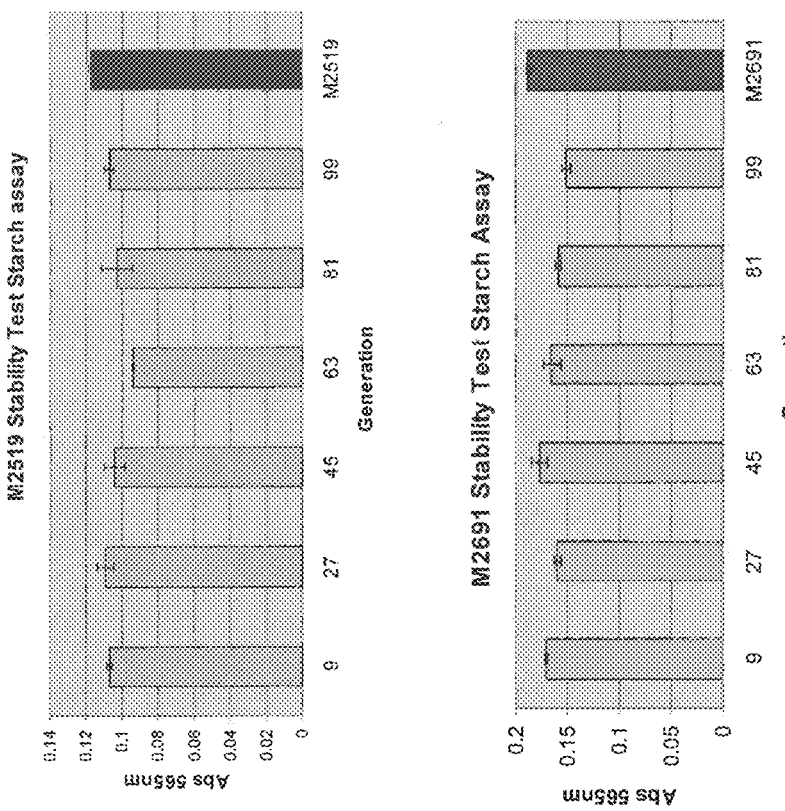

FIG. 70 depicts stability test of two M2390+AE9 transformants, M2519 (top) and M2691 (bottom). Both strains were propagated in YPD. Strains were grown to stationary phase and passaged with 100× dilution 11 times (1 passage—about 9 generations). Several samples between passages were stocked. All samples and original strain were plated and inoculated together and activity on starch was measured in the same assay. Experiment was done in triplicates.

Figure 71A:
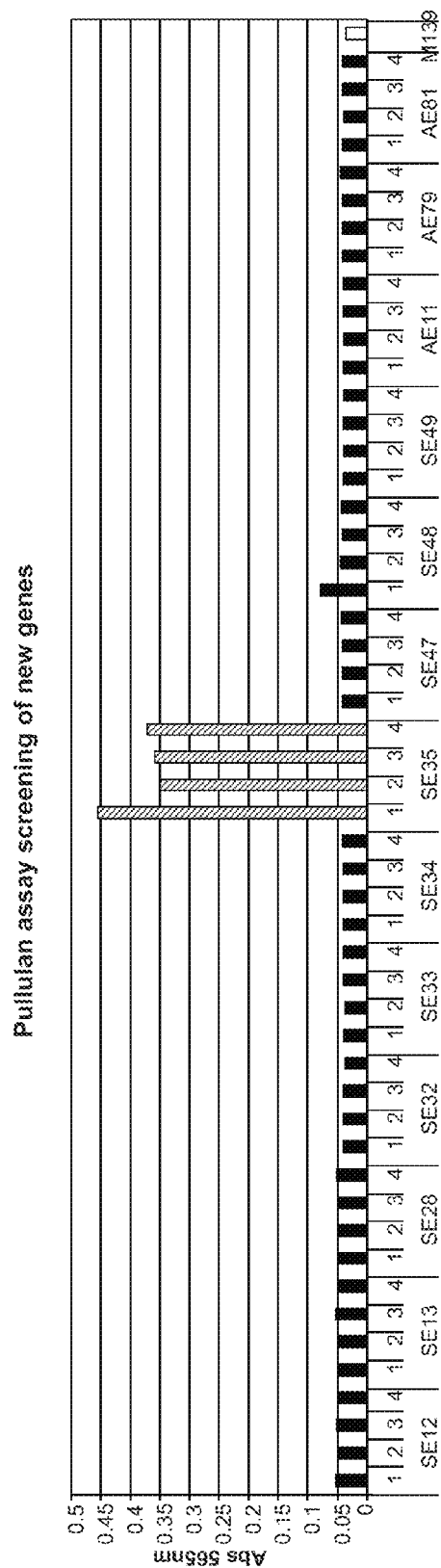
Figure 71B:
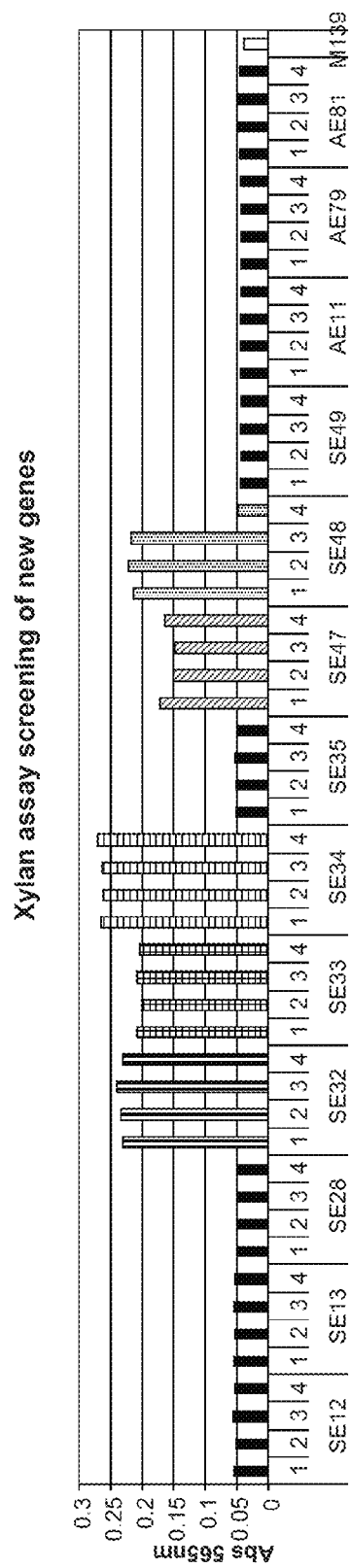
Figure 71C:
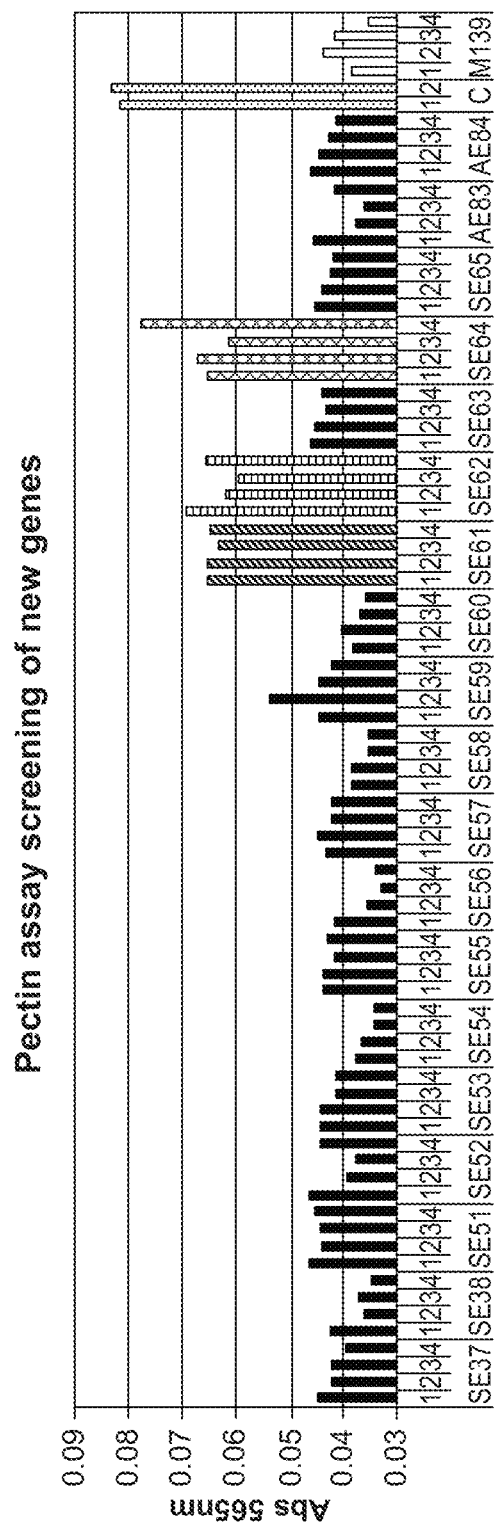

FIG. 71A depicts Pullulan, FIG. 71B depicts Xylan and FIG. 71C depicts Pectin assays of yeast secreted enzymes (Table 23). The genes were expressed under ENO1 promoter and terminator from 2-micron plasmid pMU1575. The genes were inserted between PacI/AscI sites of pMU575 either by cloning or yeast mediated ligation. Expression contracts were transformed into an industrial background Mascoma strain M1744 and selected on minimal URA deficient media. Four colonies were analyzed for each transformation. Transformants were grown in YPD for 3 days and supernatants were analyzed for activity. Supernatant of non-transformed strain M0139 (M1744 derived from M0139 through URA3 gene deletion) was used as negative control. In Pectin assay C—commercial pectinase Multifect (Genencor) diluted 10× by citrate buffer was used as positive control (5 μl used in assay).

Figure 72:
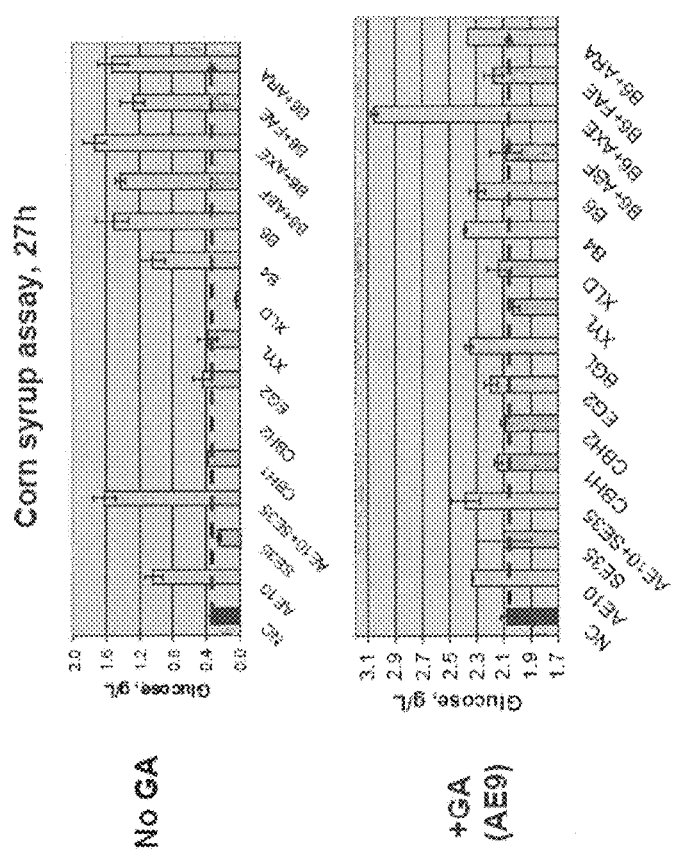

FIG. 72 depicts corn syrup assay of yeast made enzymes. CBH1, CBH2, EG2, BGL, XYL, and XLD were HPLC purified proteins. For other enzymes yeast strains expressing enzymes were grown for 3 days in YPD and supernatants were used as enzyme source (Table 24). B4—CBH1+CBH2+EG2+BGL; B6—CBH1+CBH2+EG2+BGL+XYL+XLD. Amounts of purified enzymes used in assay are summarized in the Table 25. 250 μl of M0139 (top) or M2111 (bottom) supe was added to all samples. Other supernatant derived enzymes were added in amount of 250 μl. In no other supernatant enzymes needed in the sample, M0139 supernatant was added instead. For AE10+AE35 sample 125 μl of each supernatant was added in addition to 250 μl of M0139 or M2111 supernatant. NC-no other enzymes added except for M0139 or M2111 supernatant.

Figure 73:
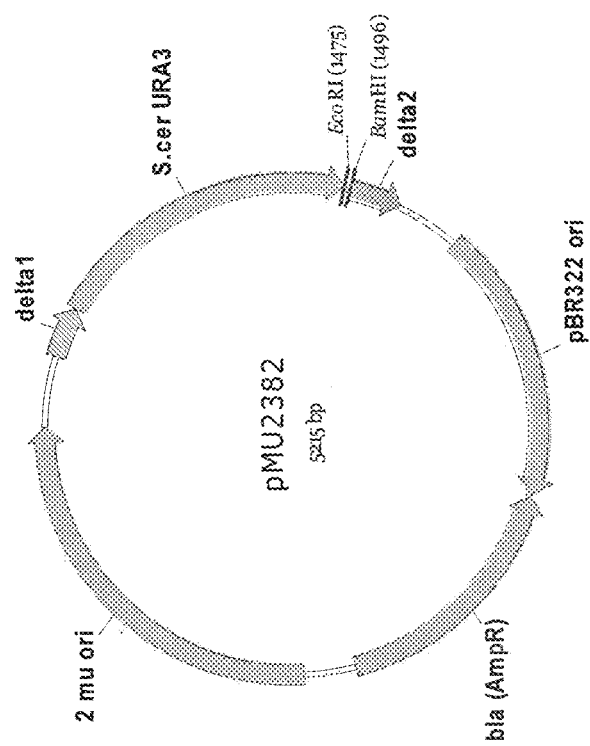

FIG. 73 depicts a map of the episomal 2-micron yeast expression vector pMU2382 used for construction of delta integration expression cassettes with genes in Table 26. Gene of interest under control of *S. cerevisiae* strong constitutive promoter and terminator was inserted between URA3 and Delta2 fragments of pMU2382 vector digested with BamHI and EcoRI. The cassette was inserted by yeast mediated ligation in the same orientation as URA3. S.ser. URA3—*S. cerevisiae* URA3 auxotrophic marker; 2 mu ori—2 micron *S. cerevisiae* plasmid origin of replication; bla(AmpR)—Amp resistance marker; pBR322—*E. coli* pB322 plasmid origin of replication, delta 1 and delta 2—fragments of *S. cerevisiae* delta sites.

Figure 74:
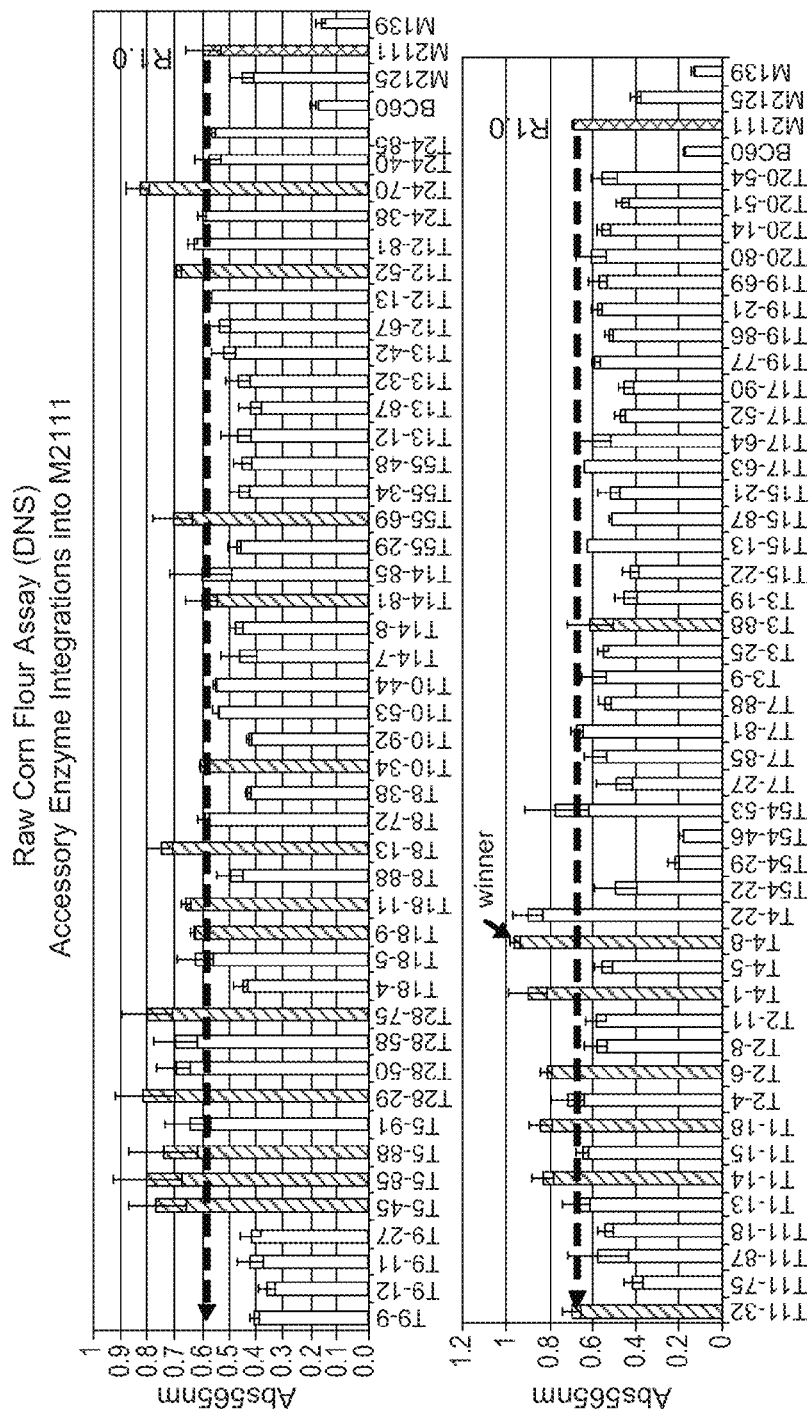

FIG. 74 depicts an example of corn flour assay of M2125 transformed with some genes and gene combos from Table 26. Transformations (T) are described in the Table 27. Number after dash means colony number for this transformation. Transformants that are highlighted were selected for screening by fermentation. BC60-M1744 strain expressing only BC60 on 2μ plasmid under ENO1 promoter. M2125-parental strain (M2111 with URA3 knockout). Untransformed M0139 strain was used as negative control.

Figure 75:
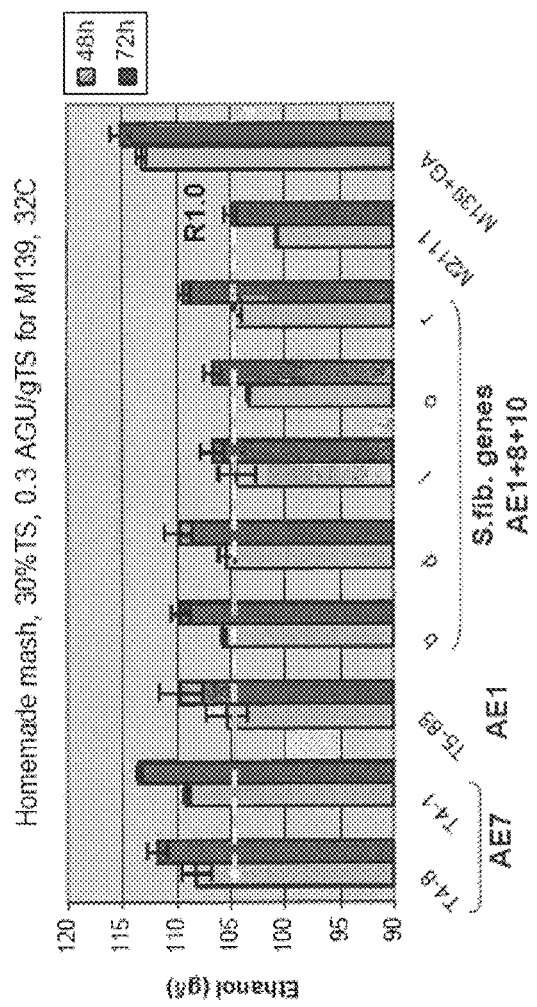

FIG. 75 depicts shake flask fermentation on homemade corn mash of strains expressing additional to AE9 saccharolytic enzymes. Strains selected based on highest ethanol titers reached in minivial corn mash fermentation assay. Homemade mash was used. The strains are described in the Table 28. Fermentation was performed at 30% of total solids and 32° C. Exogenous enzyme was added to the untransformed M0139 strain only, at concentration 0.3 AGU/g of solids. Parental M2111 strain was used as background control. The experiment was done in duplicates. Commercial enzyme Spirizyme Ultra (Novozymes) was used as exogenous glucoamylase. Ethanol was measured by HPLC.

Figure 76:
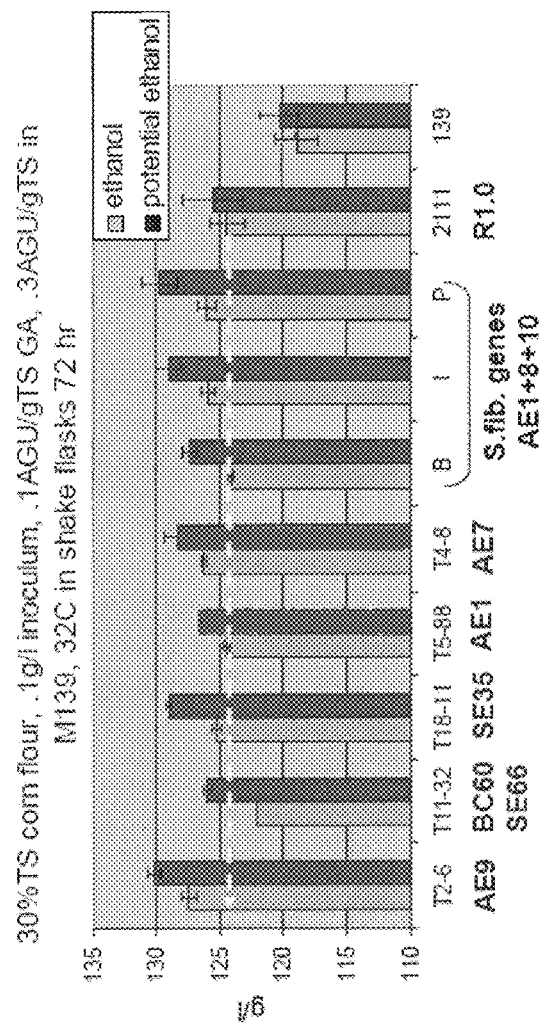

FIG. 76 depicts shake flask fermentation on corn flour of strains expressing additional to AE9 saccharolytic enzymes. Strains selected based on highest ethanol titers reached in minivial corn flour fermentation assay. The strains are described in the Table 29. Fermentation was performed at 30% of total solids and 32° C. Exogenous enzyme was added to the untransformed M0139 strain at concentration 0.3 AGU/g of solids and at 0.1 AGU/g to all other strains. Parental M2111 strain was used as background control. The experiment was done in duplicates. Commercial enzyme Spirizyme Ultra (Novozymes) was used as exogenous glucoamylase. Ethanol and sugars were measured by HPLC. Potential ethanol was calculated based on glucose concentration (added theoretical ethanol from unconsumed glucose).

Figure 77:
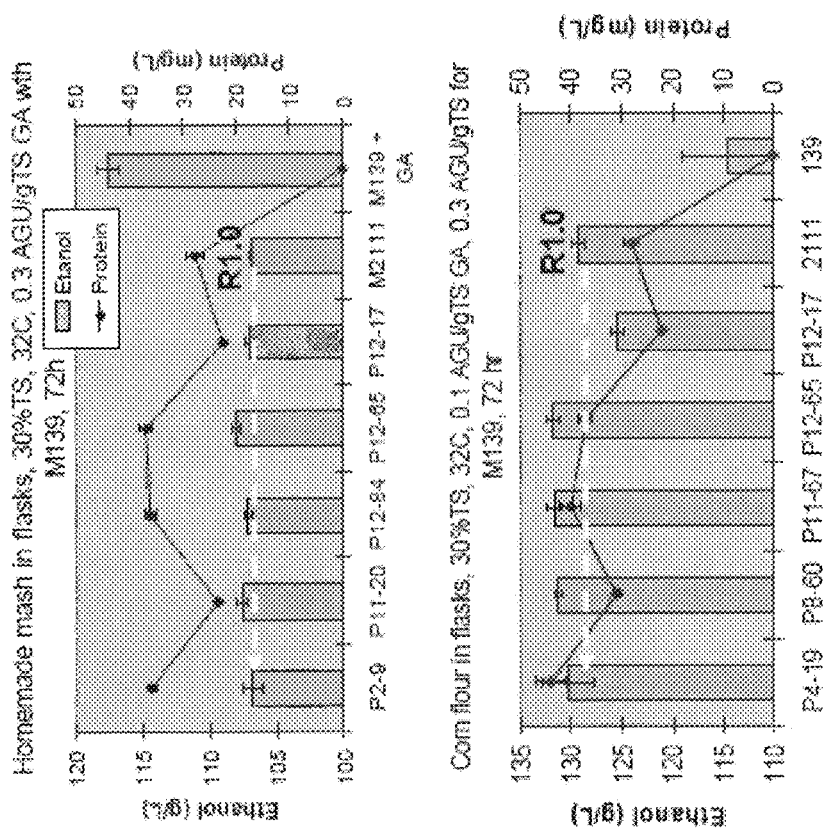

FIG. 77 depicts shake flask fermentation on homemade corn mash (top) and corn flour (bottom) of strains expressing AE9 only. The strains were result of repeating the same transformation as was done in M2111 construction with consequent screening of 1000 colonies for activity on starch. Strains for this shake flask experiment were selected based on highest ethanol titers reached in minivial corn homemade mash and flour fermentation assays. The strains are described in Tables 30 and 31. Fermentation was performed at 30% of total solids and 32° C. Exogenous enzyme was added to the untransformed M0139 strain at concentration 0.3 AGU/g of solids. In corn flour experiment exogenous enzyme was also added to all other strains at concentration 0.1 AGU/g of solids. Previously constructed M2111 strain was included for comparison. The experiment was done in duplicates. Commercial enzyme Spirizyme Ultra (Novozymes) was used as exogenous glucoamylase. Line—protein (AE9) secreted by the strains after 3 days growth in YPD shake flasks (separate from fermentation experiment). Ethanol and protein concentration were measured by HPLC.

Figure 78:
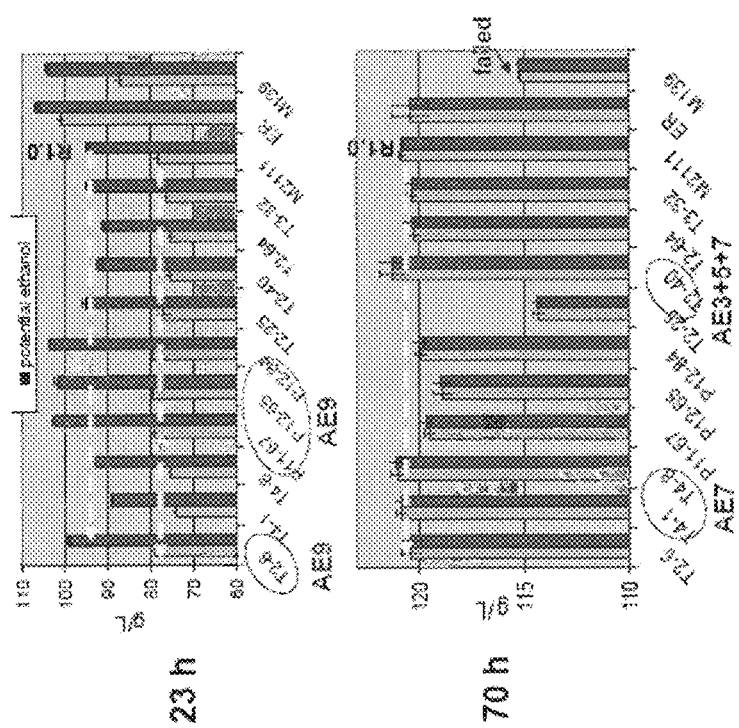

FIG. 78 depicts shake flask fermentation on industrial corn mash of the best strains from shake flask screening experiments on homemade mash and corn flour (FIGS. 75-77). The strains are described in Table 32. Fermentation was performed at 30% of total solids and 32° C. Exogenous enzyme was added to the untransformed M0139 strain only, at concentration 0.3 AGU/g of solids. M2111 strain was included for comparison. The experiment was done in duplicates. Commercial enzyme Spirizyme Ultra (Novozymes) was used as exogenous glucoamylase. Ethanol and sugars concentration were measured by HPLC. Potential ethanol was calculated based on glucose concentration (added theoretical ethanol from unconsumed glucose).

Figure 79:
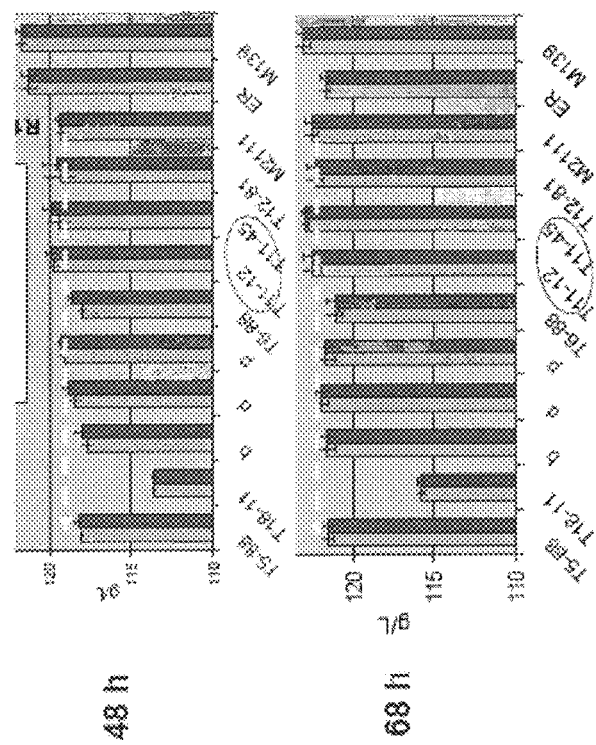

FIG. 79 depicts shake flask fermentation on industrial corn mash of the best strains from shake flask screening experiments on homemade mash and corn flour (FIGS. 75-77). The strains are described in Table 33. Fermentation was performed at 30% of total solids and 32° C. Exogenous enzyme was added to the untransformed M0139 strain only, at concentration 0.3 AGU/g of solids. M2111 strain was included for comparison. The experiment was done in duplicates. Commercial enzyme Spirizyme Ultra (Novozymes) was used as exogenous glucoamylase. Ethanol and sugars concentration were measured by HPLC. Potential ethanol was calculated based on glucose concentration (added theoretical ethanol from unconsumed glucose).

Figure 80:
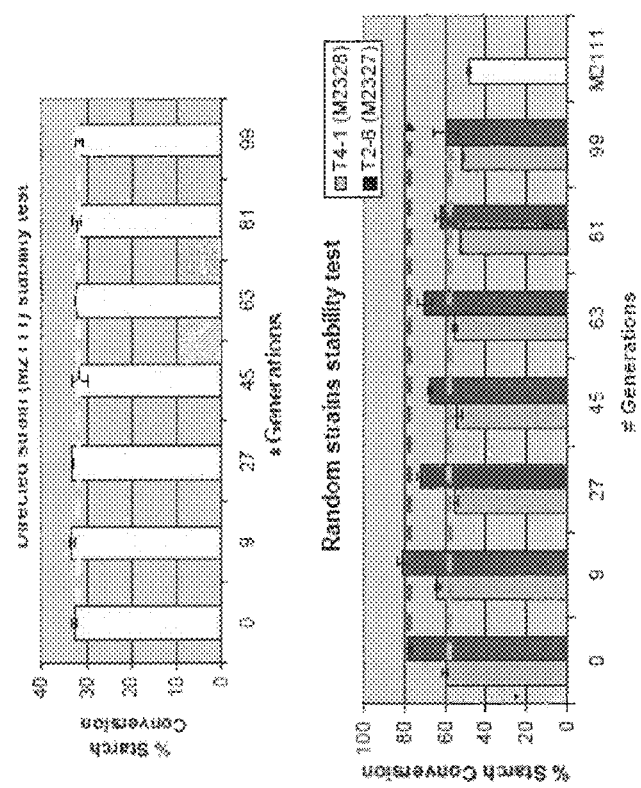

FIG. 80 depicts stability test of M2111 strain built by directed integration (top) and strains built by random integration (bottom). The strains were propagated in YPD, grown to stationary phase and passaged with 100× dilution 11 times (1 passage—about 9 generations). Several samples between passages were stocked. All samples and original strain were plated and inoculated together and activity on starch was measured in the same assay. Random strains are described in Table 32. The experiment was done in triplicates.

Figure 81:
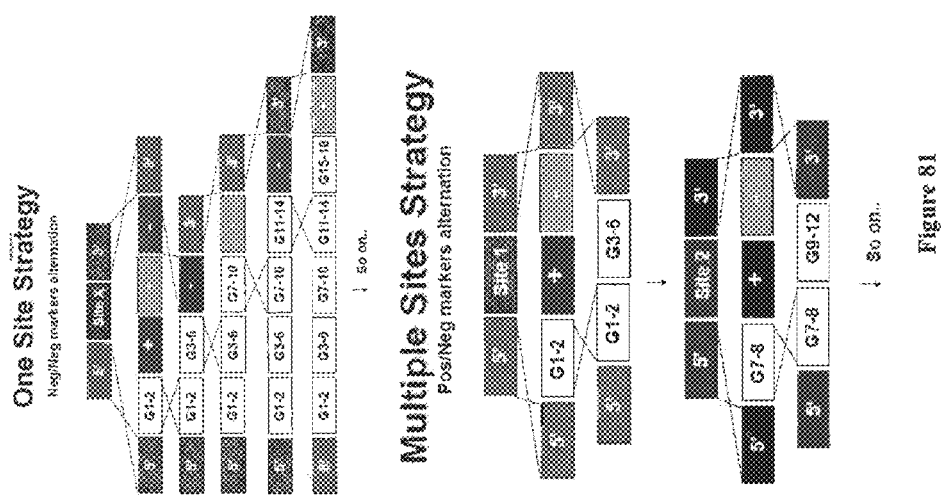

FIG. 81 depicts different possible strategies for directed strains construction. Top—one site integration strategy; bottom—multiple sites integration strategy. In one site strategy negative markers alternate in each transformation round and all expression cassettes are integrated into the same locus next to each other. In multiple sites strategy positive and negative markers alternate with each other and in each round of transformation the expression cassette can be integrated into any site on chromosome.

Figure 82:
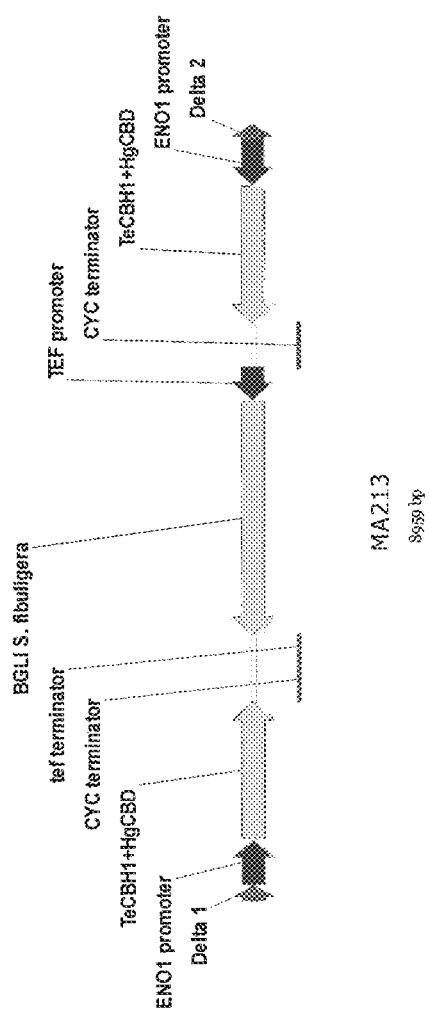

FIG. 82 depicts a schematic of TeCBH1+HgCBD expression construct for integration at the δ sites in *S. cerevisiae*.

Figure 83:
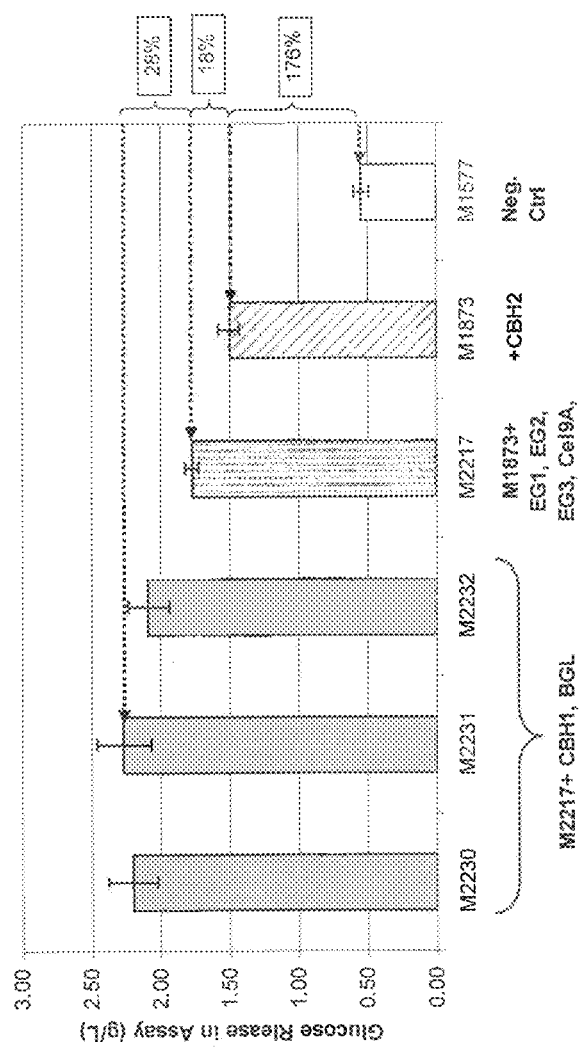

FIG. 83 depicts assay of supernatants containing cellulases on pretreated hardwood made by several strains of *S. cerevisiae*. Supernatants were incubated with pretreated hardwood at 4% total solids, an exogenous cellulase preparation at a 2 mg enzyme/g total solids loading in the PHW assay. Accumulation of glucose in the reaction was measured by HPLC.

Figure 84:
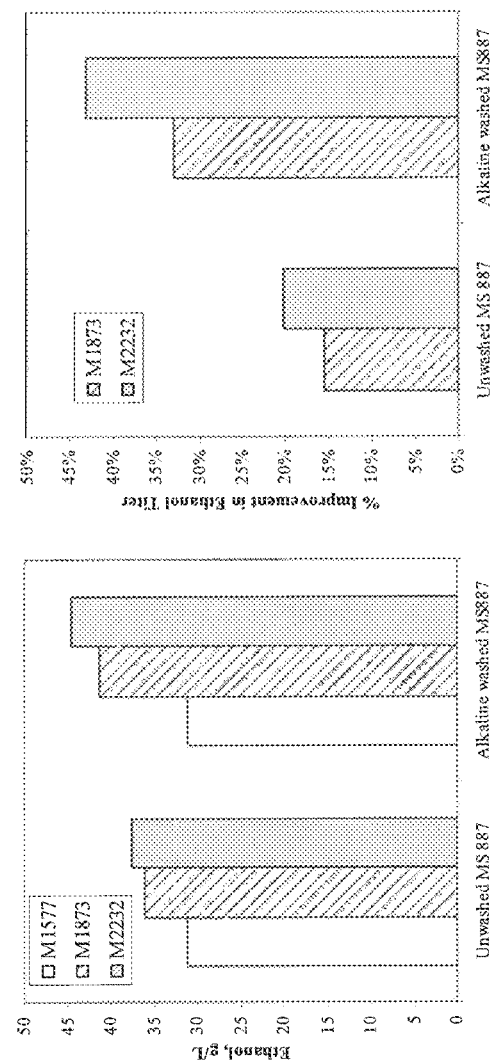

FIG. 84 depicts a comparison of cellulolytic strains containing either just one enzyme (CBH2, M1873), or seven enzymes (M2232) to the control non-cellulase producing M1577 for ethanol production in SSF. Both unwashed pretreated hardwood, and alkaline washed pretreated hardwood substrates were used. Data is presented from 160 hours of fermentation.

Figure 85:
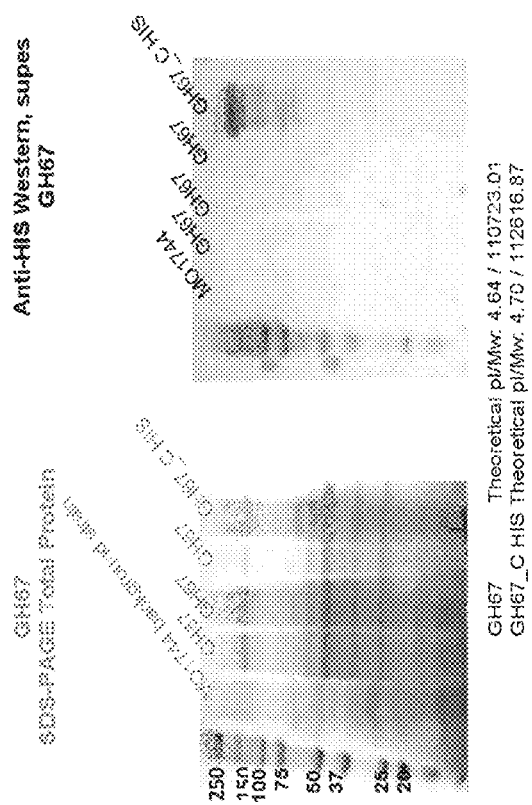

FIG. 85 depicts SDS-PAGE (left) and Western blot (right) of yeast made alpha-glucuronidase. Alpha-glucuronidase, GH67 was PCR amplified from *Pichia stipitis* genomic DNA and cloned+/− C-terminal Histidine tag. Colonies from transformations were grown in yeast extract (10 g/L), peptone (20 g/L), and glucose (20 g/L)+200 µg/mL Zeocin, pH 7.0 in 50 mL vented conical tubes for 48-60 hours. Cultures supernatants were filtered through a 2 µm PE filter and concentrated approximately 20-fold in a 10,000 Da molecular weight cut off filter. Protein quality was screened via SDS-PAGE electrophoresis under non-reducing conditions and stained with Coomassie Blue dye (left) or examined by Western Blot (right) using an anti-Histidine primary antibody and alkaline phosphatase conjugated secondary antibody (only His tagged constructs visualized).

Figure 86:
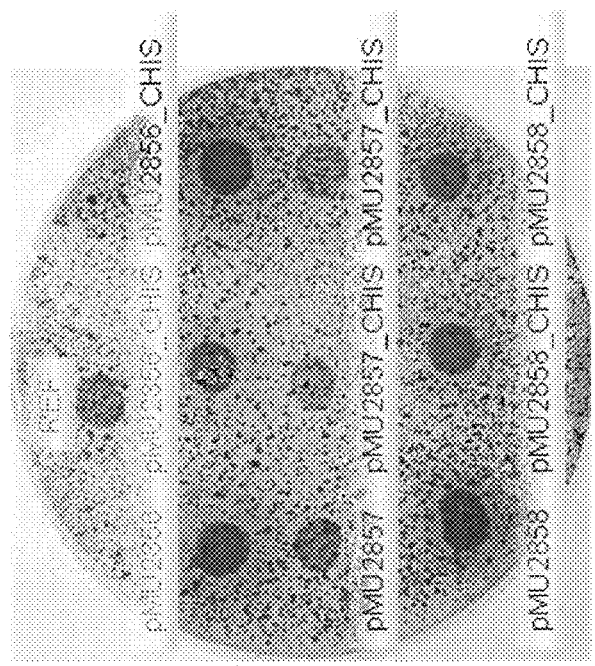

FIG. 86 depicts xyloglucanase activity on AZCL-xyloglucan agar plates. Equal amounts of culture were spotted onto SC agar plates containing 0.5% AZCL (Azurine-Crosslinked) tamarind xyloglucan Megazyme catalog # I-AZXYG. Xyloglucanase activity is indicated as blue zones such as those strains transformed with pMU2856 and pMU2858+/− His tag. REF refers to control MO1744 background strain supernatant.

Figure 87:
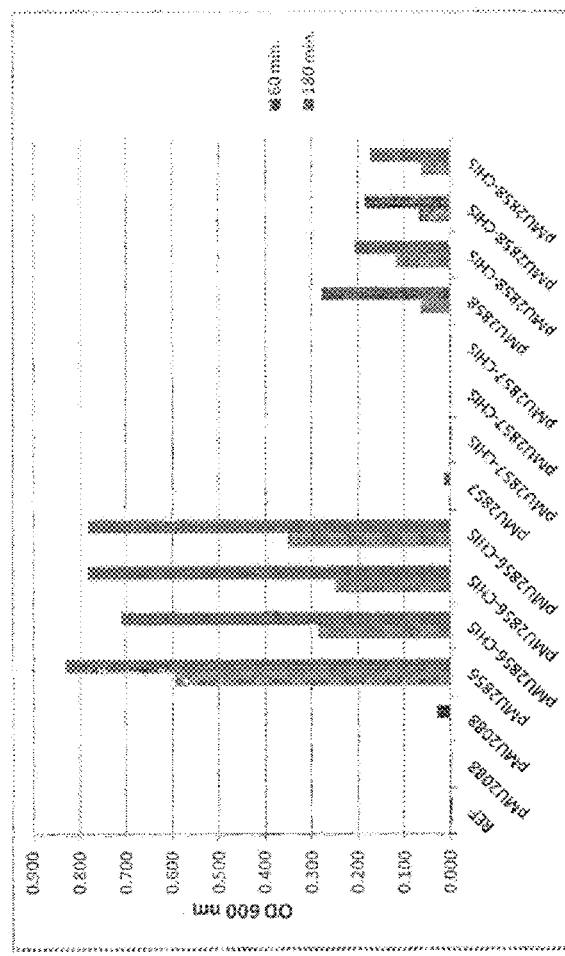

FIG. 87 depicts xyloglucanase activity in AZCL-xyloglucan. 70 µL of supernatant of 3 day old 2×SC$^{-ura}$ cultures were added to 280 µL of 50 mM Na-Acetate buffer (pH 5.0) containing 0.5% AZCL (Azurine-Crosslinked) tamarind xyloglucan Megazyme catalog # I-AZXYG in a deep-well microtiter plate. The plate was incubated in a microtiter plate shaker at 35° C. at 800 rpm agitation. Samples of 100 µL were taken at 0, 60 and 180 minutes of incubation, spun down at 3000 rpm (2 minutes) after which 50 µL of the supernatant was placed in a fresh microtiter plate and the OD at 600 nm was determined so that the increased OD over time could be measured. REF refers to control MO744 background strain.

Figure 88:

FIG. 88 depicts SDS-PAGE (left) and Western (right) analysis of yeast expressed xyloglucanases+/− His tags. Three days old cultures in double strength SC$^{-URA}$ media buffered to pH6.0 (3 mL cultures in test tubes incubated at 30° C. on rotary wheel) were centrifuged and supernatants assayed by loading 15 µL (+5 µL loading buffer) onto 10% SDS-PAGE gels. REF refers to control MO1744 background strain supernatant.

Figure 89:
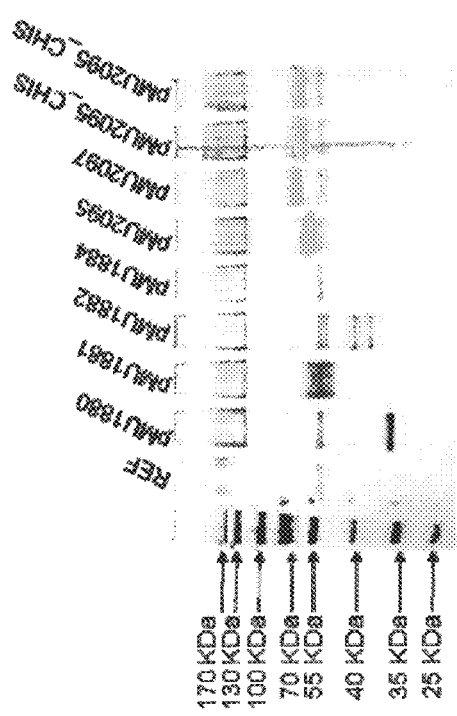

FIG. 89 depicts SDS-PAGE analysis of esterases expressed in *Saccharomyces cerevisiae*. Three day old cultures in double strength SC$^{-URA}$ media buffered to pH6.0 (3 mL cultures in test tubes incubated at 30° C. on rotary wheel) were centrifuged and supernatants assayed by loading 15 µL (+5 µL loading buffer) onto 10% SDS-PAGE gels and silver stained. REF refers to control MO1744 background strain supernatant.

Figure 90:
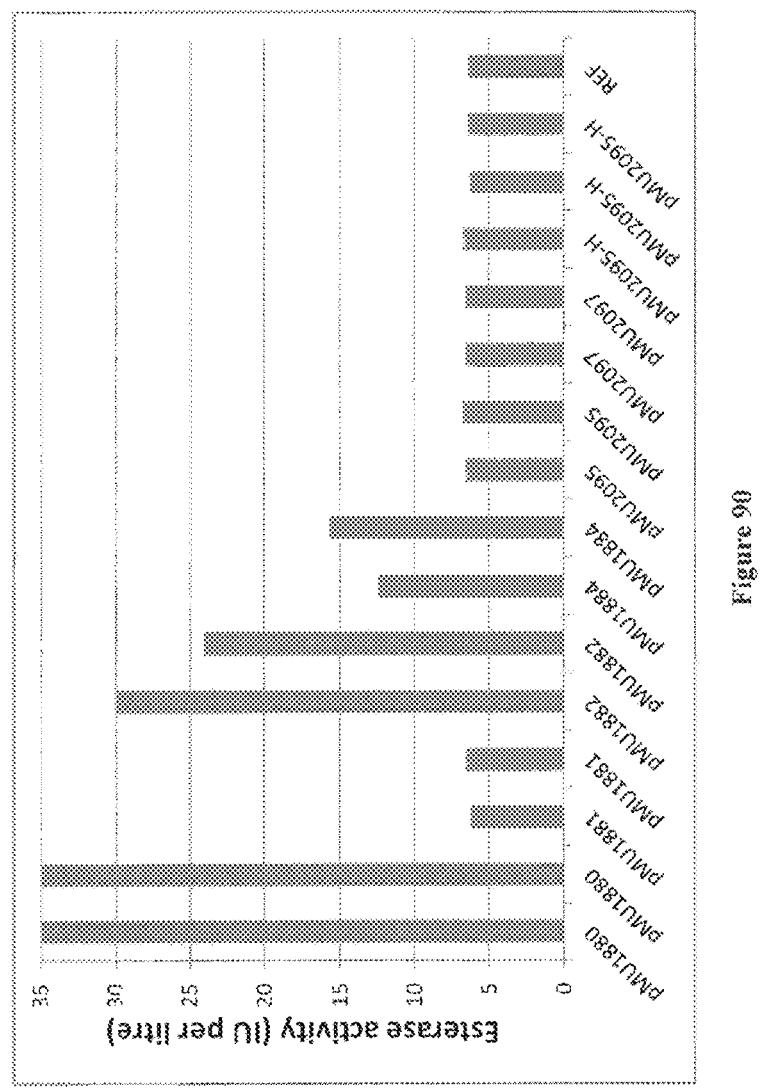

FIG. 90 depicts 1-Napthyl-acetate esterase assay of yeast made esterases. Experiment was performed in duplicates. REF refers to control M1744 background strain supernatant.

Figure 91:
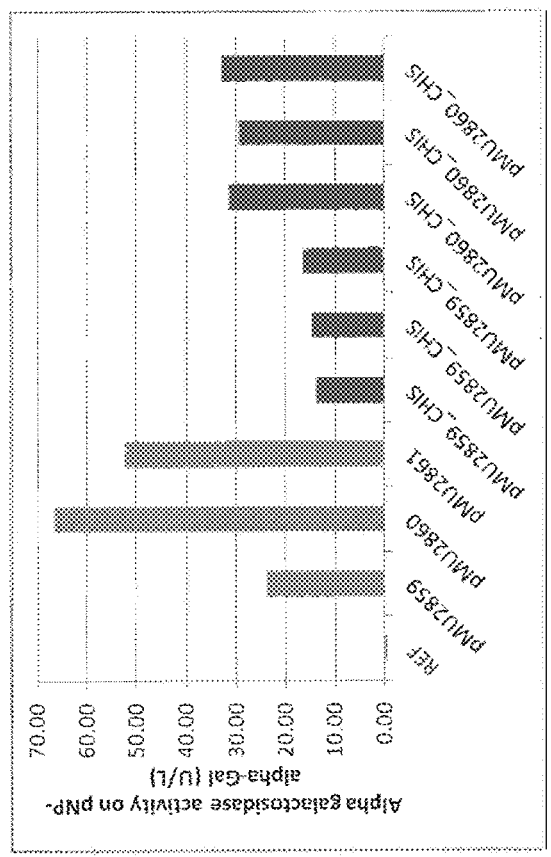

FIG. 91 depicts Alpha-galactosidase activity assay with yeast made alpha-galactosidases. Experiment was performed in duplicates. REF refers to control M1744 background strain supernatant.

Figure 92:
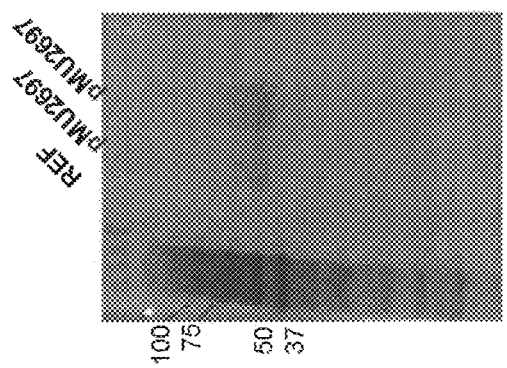

FIG. 92 depicts Western blot analysis of *T. reesei* alpha-galactosidase (AGL3)+/− His tag expression in *Saccharomyces cerevisiae*. Colonies from transformations were grown in yeast extract (10 g/L), peptone (20 g/L), and glucose (20 g/L)+200 ug/mL Zeocin, pH 7.0 in 50 mL vented conical tubes for 48-60 hours. Cultures supernatants were filtered through a 2 μm PE filter and concentrated approximately 20-fold in a 10,000 molecular weight cut off filter. Protein quality was screened via SDS-PAGE electrophoresis under non-reducing conditions and examined by Western Blot using an anti-Histidine primary antibody and alkaline phosphatase conjugated secondary antibody (only His tagged constructs visualized).

Figure 93:
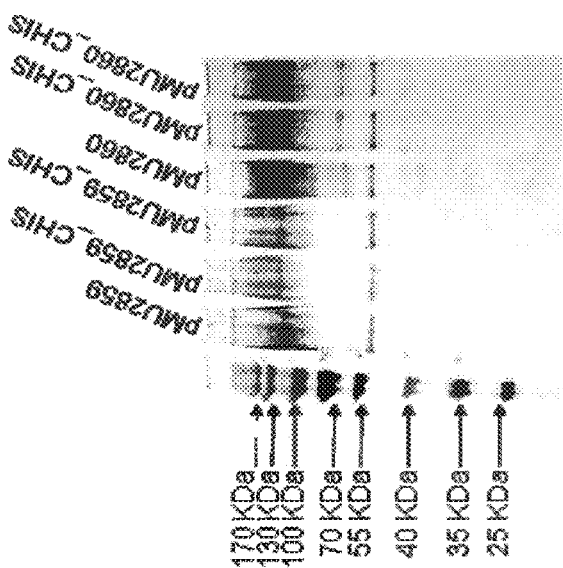

FIG. 93 depicts SDS-PAGE analysis of alpha-galactosidases expression in *Saccharomyces cerevisiae*. Three day old cultures in double strength $SC^{-URA}$ media buffered to pH6.0 (3 mL cultures in test tubes incubated at 30° C. on rotary wheel) were centrifuged and supernatants assayed, and 15 μL (+5 μL loading buffer) was loaded onto 10% SDS-PAGE gels and silver stained.

Figure 94:
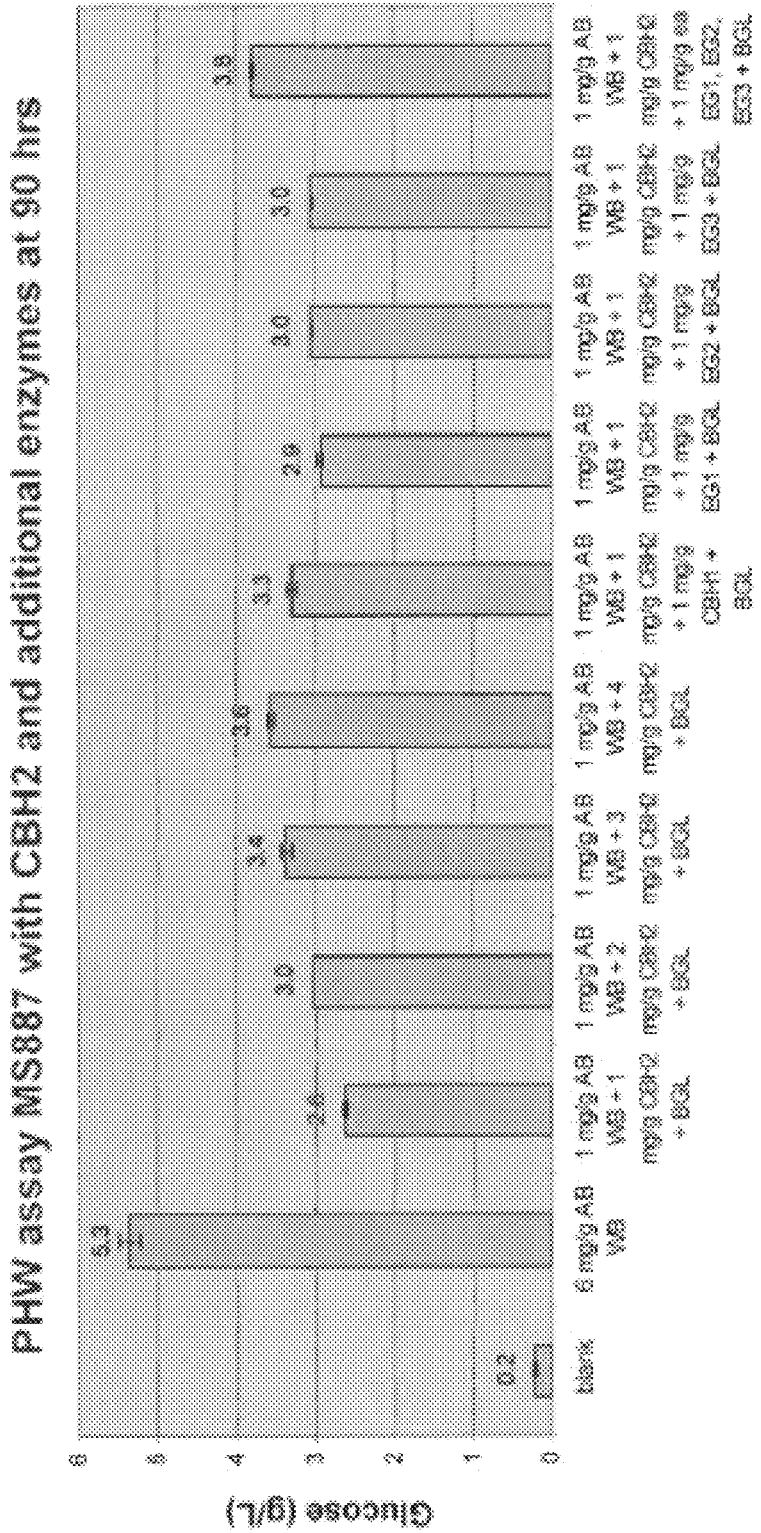
Figure 95:
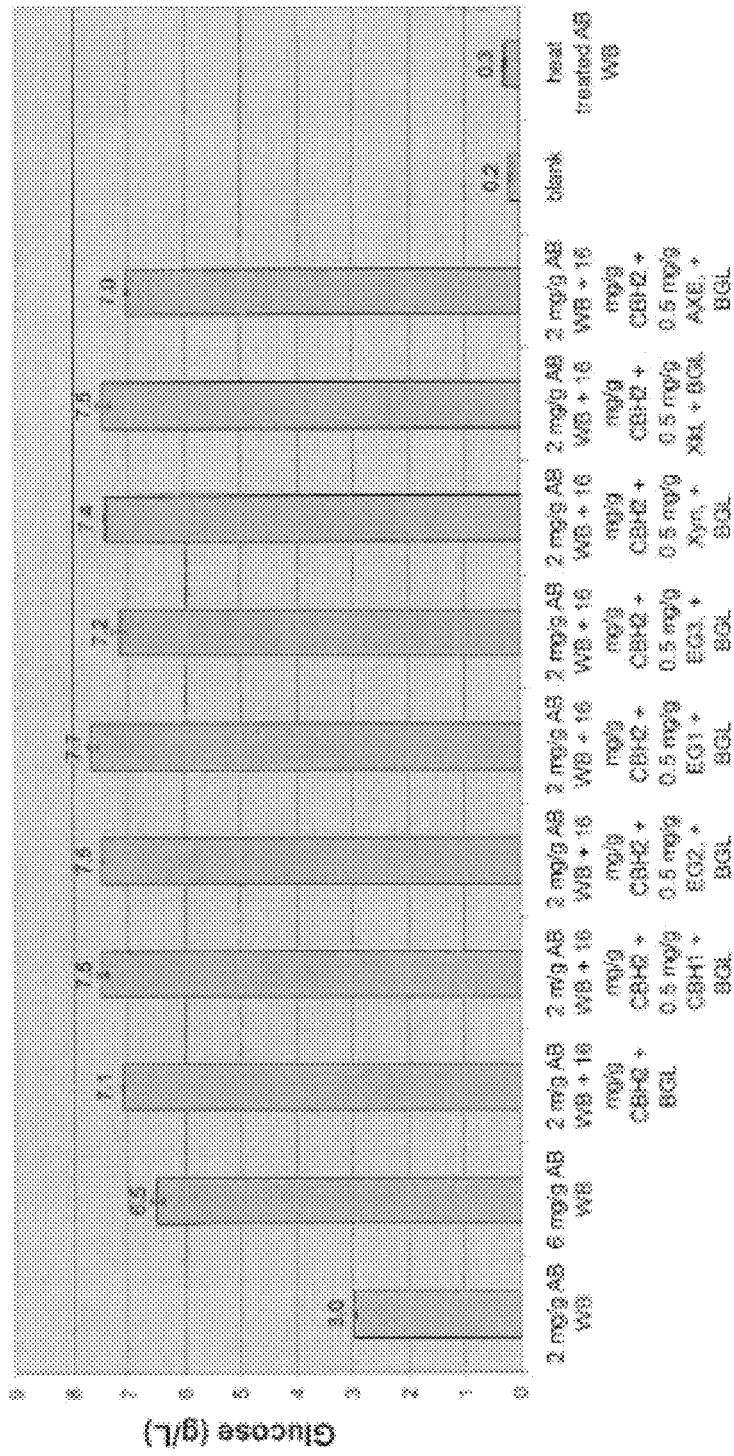

FIG. 94 depicts a 2% total solids PWH assay with different combinations of commercial and yeast made purified enzymes and the resultant glucose release. The assay plate was incubated at 38° C. and samples were removed at various time points for HPLC analysis on the BioRad 87H column FIG. 95 depicts a 2% total solids PWH assay with different combinations of commercial and yeast made purified enzymes and the resultant glucose release. The assay plate was incubated at 38° C. and samples were removed at various time points for HPLC analysis on the BioRad 87H column.

Figure 96:
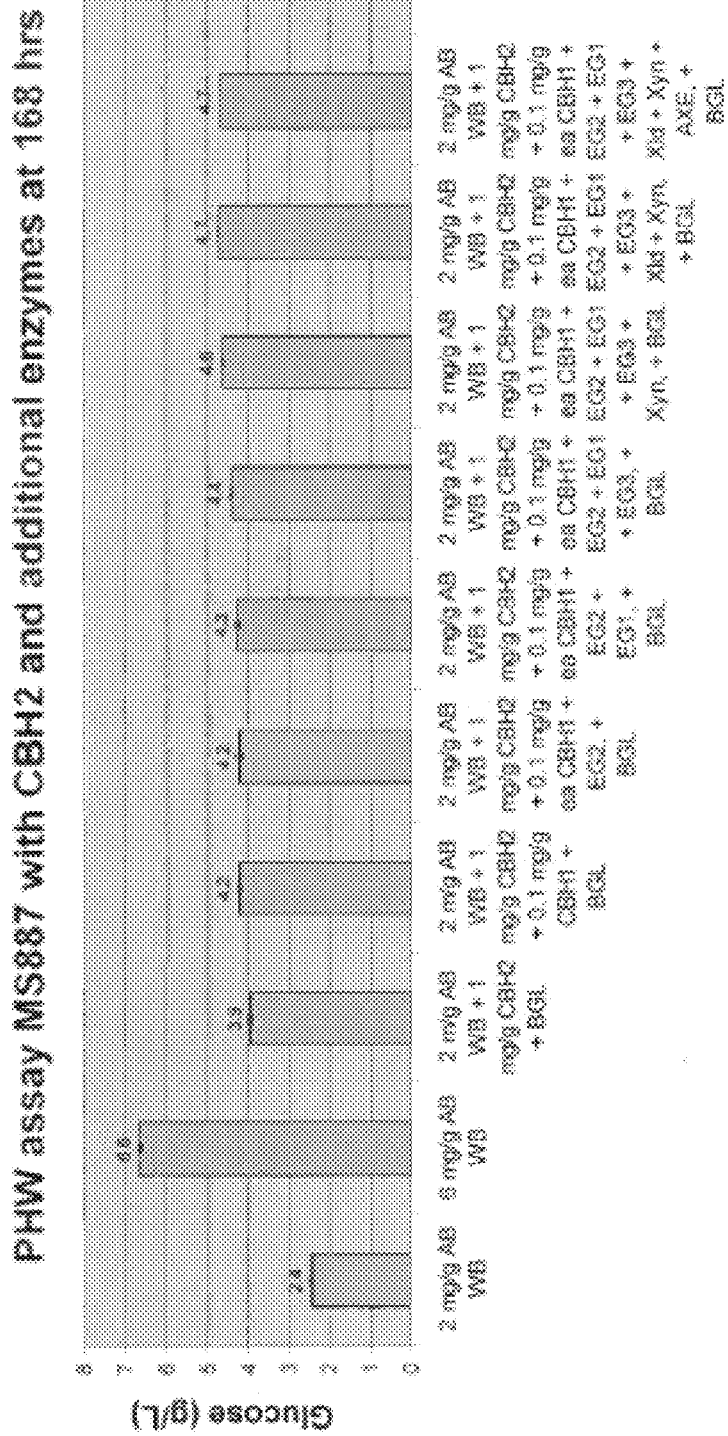

FIG. 96 depicts a 2% total solids PWH assay with different combinations of commercial and yeast made purified enzymes and the resultant glucose release. The assay plate was incubated at 38° C. and samples were removed at various time points for HPLC analysis on the BioRad 87H column.

Figure 97:
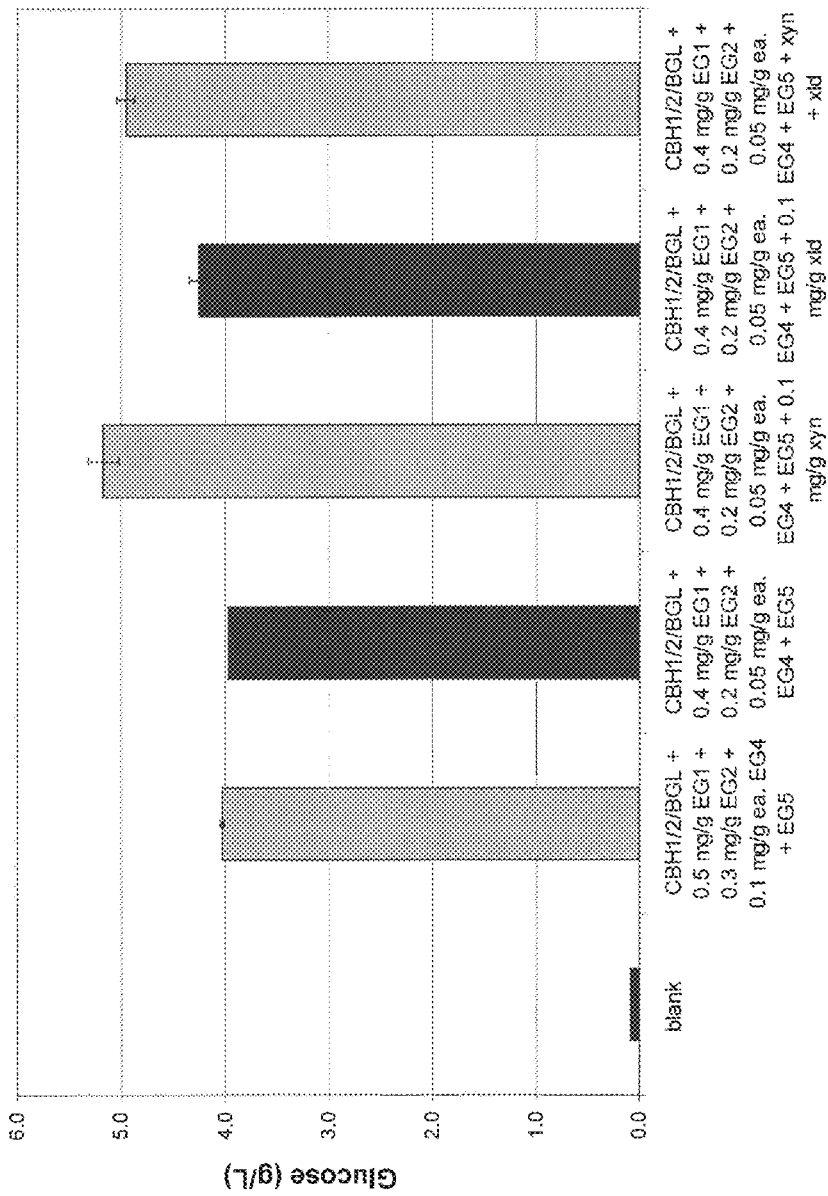

FIG. 97 depicts a 2% total solids paper sludge assay of different combinations of yeast made purified enzymes and the resultant glucose release. The assay plate was incubated at 38° C. and samples were removed at various time points for HPLC analysis on the BioRad 87H column.

Figure 98:
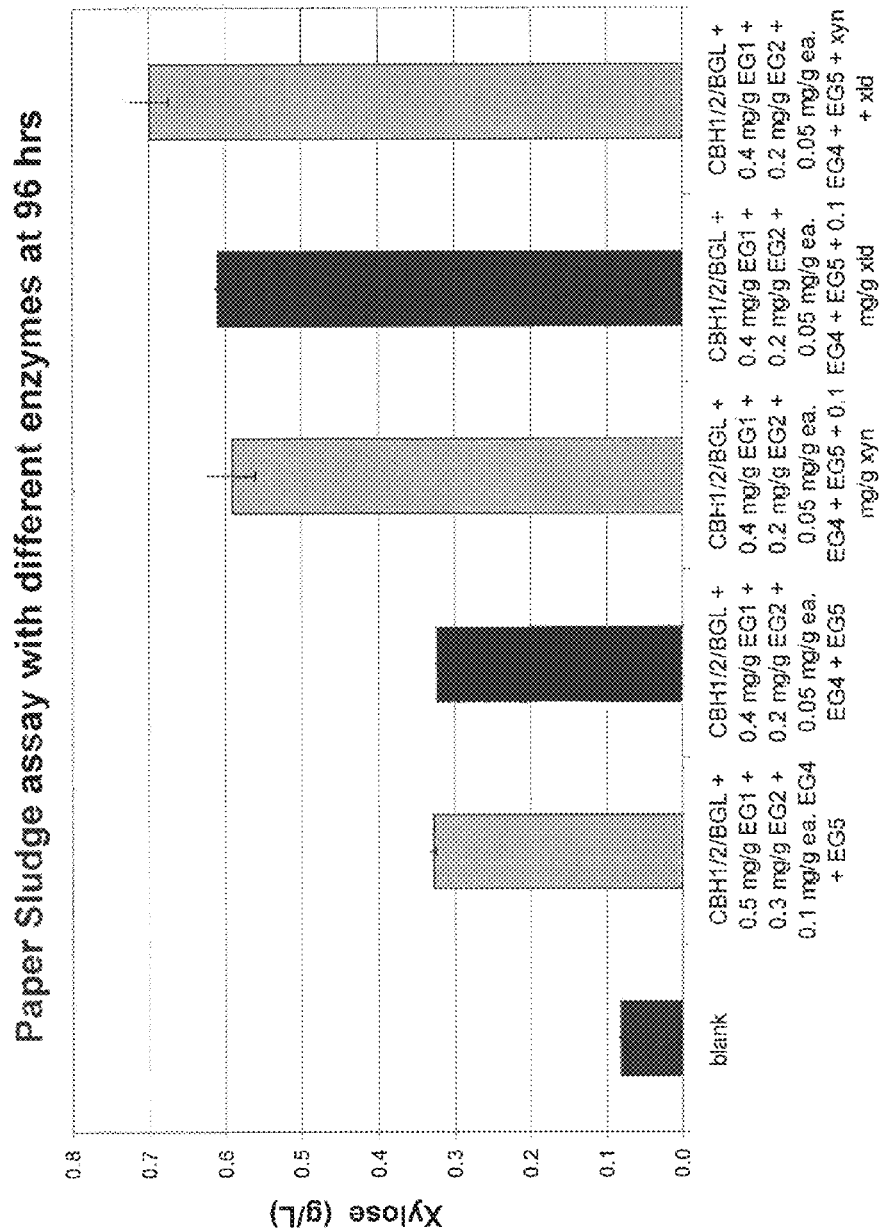

FIG. 98 depicts a 2% total solids paper sludge assay of different combinations of yeast made purified enzymes and the resultant xylose release. The assay plate was incubated at 38° C. and samples were removed at various time points for HPLC analysis on the BioRad 87H column.

Figure 99:
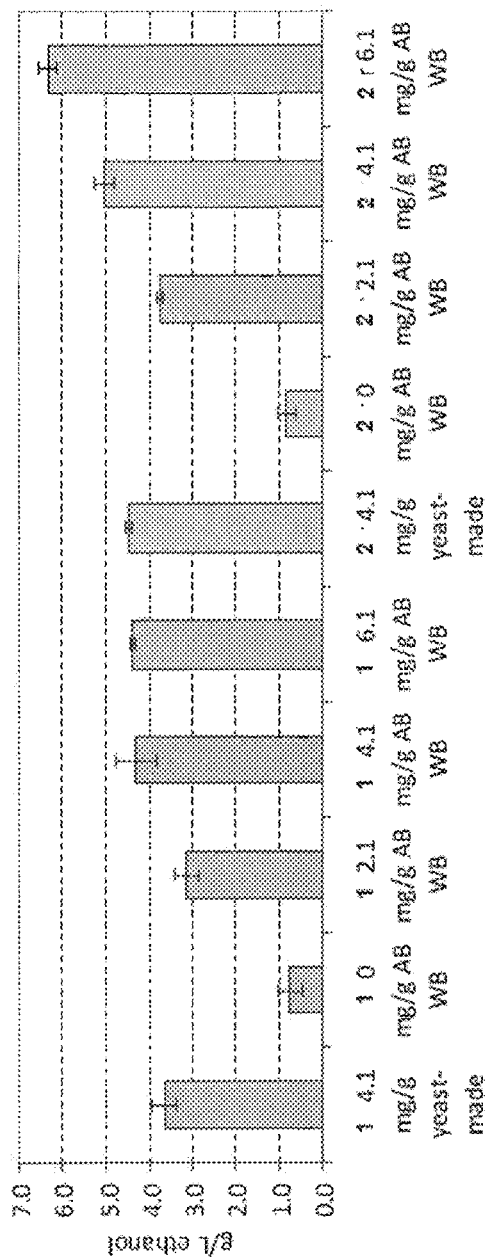

FIG. 99 depicts final ethanol titers (92 hours) for 2 different industrial paper sludges SSF. Sludge 1—first 5 bars; Sludge 2—last 5 bars. Washed (1M Citric acid) 2% solids paper sludges were used. Strain M2108 was inoculated at 1.1 g/l. Fermentation was performed at pH5.0, 35° C., 220 rpm, 92 hrs.

Figure 100:
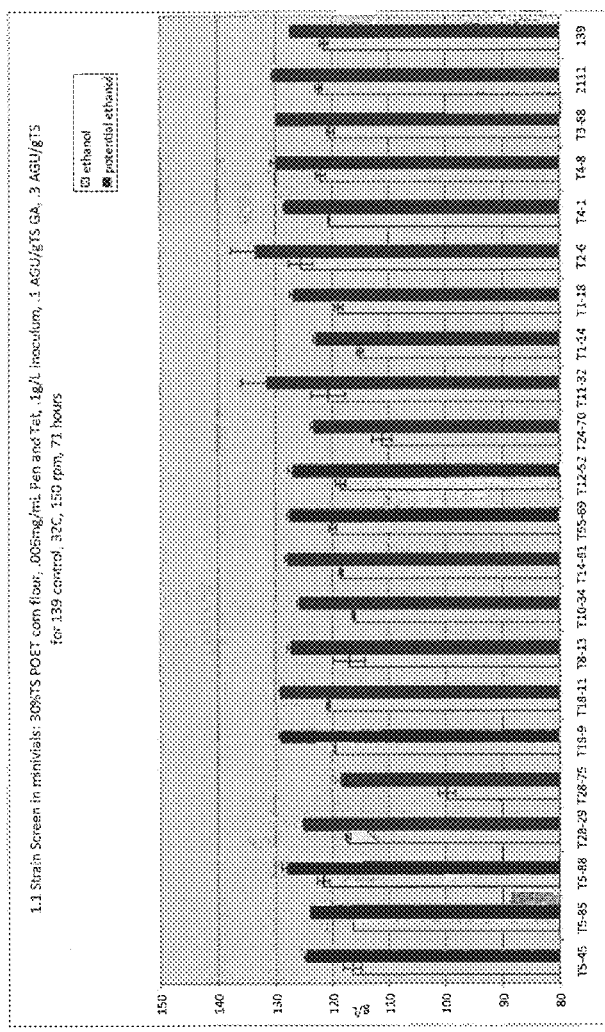

FIG. 100 depicts ethanol and potential ethanol titers achieved on 30% TS corn flour with 0.1 AGU/g TS exogenous gluco-amylase. The control strain (M0139) has a full dose (0.3 AGU/g TS) of gluco-amylase.

Figure 101:
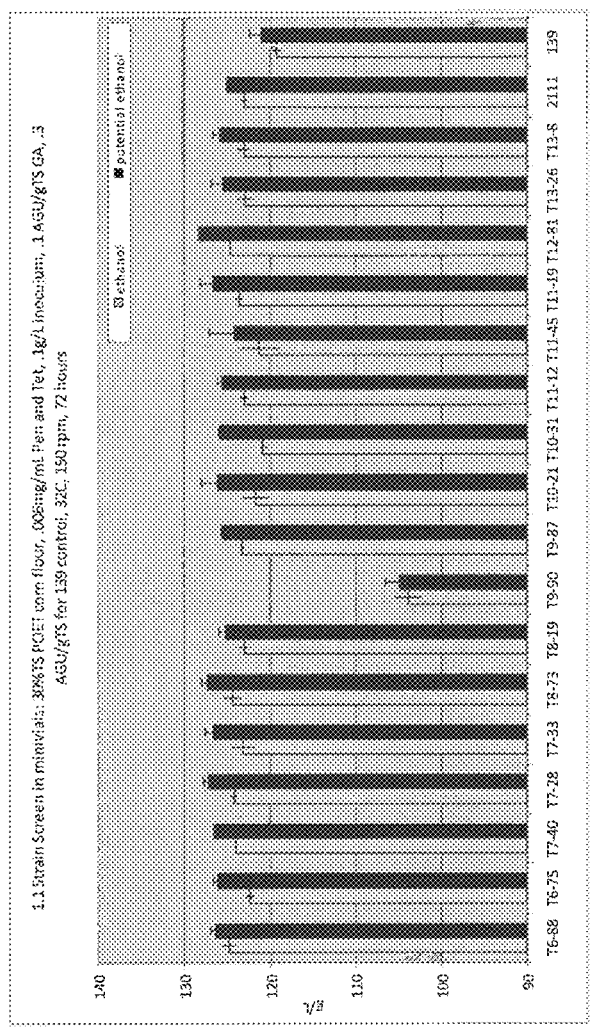

FIG. 101 depicts ethanol and potential ethanol titers at 72 hours for xylanase and accessory enzyme screen on 30% TS corn flour (ELN afoster2 corn-090).

Figure 102:
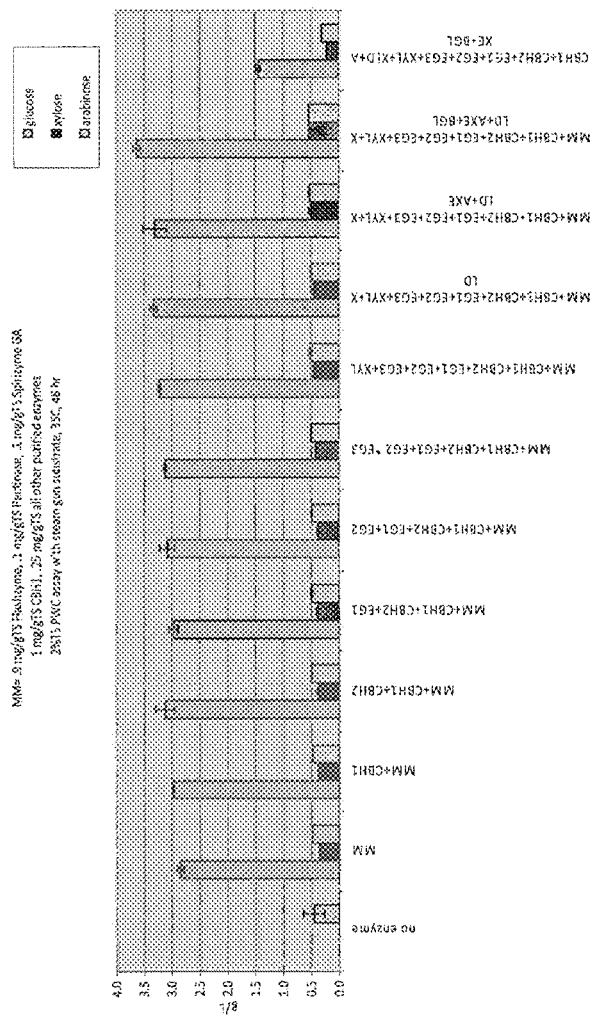

FIG. 102 depicts glucose, xylose and arabinose released from a hydrolysis of 2% TS pretreated wet cake.

Figure 103:
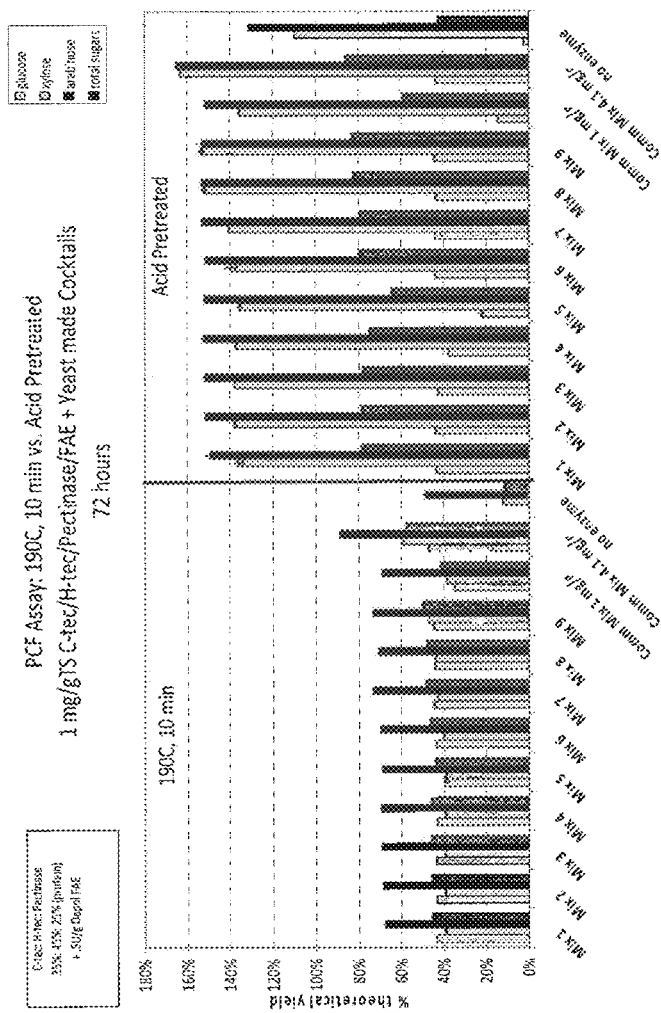

FIG. 103 depicts hydrolysis yields from 190° C., 10 minutes water pretreated coarse fiber and 1% sulfuric acid pretreated coarse fiber.

DETAILED DESCRIPTION OF THE INVENTION

The disclosed methods and materials are useful generally in the field of engineered yeast.
Definitions
A "vector," e.g., a "plasmid" or "YAC" (yeast artificial chromosome) refers to an extrachromosomal element often carrying one or more genes that are not part of the central metabolism of the cell, and is usually in the form of a circular double-stranded DNA molecule. Such elements may be autonomously replicating sequences, genome integrating sequences, phage or nucleotide sequences, linear, circular, or supercoiled, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. Preferably, the plasmids or vectors of the present invention are stable and self-replicating.

An "expression vector" is a vector that is capable of directing the expression of genes to which it is operably associated.

The term "intergrated" as used herein refers to genetic elements that are placed, through molecular biology techniques, into the genome of a host cell. For example, genetic elements can be placed into the chromosomes of the host cell as opposed to in a vector such as a plasmid carried by the host cell. Methods for integrating genetic elements into the genome of a host cell are well known in the art and include homologous recombination.

The term "heterologous" when used in reference to a polynucleotide, a gene, a polypeptide, or an enzyme refers to a polynucleotide, gene, polypeptide, or an enzyme not normally found in the host organism. "Heterologous" also includes a native coding region, or portion thereof, that is removed from the source organism and subsequently reintroduced into the source organism in a form that is different from the corresponding native gene, e.g., not in its natural location in the organism's genome. The heterologous polynucleotide or gene may be introduced into the host organism by, e.g., gene transfer. A heterologous gene may include a native coding region that is a portion of a chimeric gene including non-native regulatory regions that is reintroduced into the native host. Foreign genes can comprise native genes inserted into a non-native organism, or chimeric genes. A heterologous polynucleotide, gene, polypeptide, or an enzyme may be derived from any source, e.g., eukaryotes, prokaryotes, viruses, or synthetic polynucleotide fragments. The term "heterologous" as used herein also refers to an element of a vector, plasmid or host cell that is derived from a source other than the endogenous source. Thus, for example, a heterologous sequence could be a sequence that is derived from a different gene or plasmid from the same host, from a different strain of host cell, or from an organism of a different taxonomic group (e.g., different kingdom, phylum, class, order, family genus, or species, or any subgroup within one of these classifications). The term "heterologous" is also used synonymously herein with the term "exogenous."

The term "domain" as used herein refers to a part of a molecule or structure that shares common physical or chemical features, for example hydrophobic, polar, globular, helical domains or properties, e.g., a DNA binding domain or an ATP binding domain. Domains can be identified by their homology to conserved structural or functional motifs. Examples of cellobiohydrolase (CBH) domains include the catalytic domain (CD) and the cellulose binding domain (CBD).

A "nucleic acid," "polynucleotide," or "nucleic acid molecule" is a polymeric compound comprised of covalently linked subunits called nucleotides. Nucleic acid includes polyribonucleic acid (RNA) and polydeoxyribonucleic acid (DNA), both of which may be single-stranded or double-stranded. DNA includes cDNA, genomic DNA, synthetic DNA, and semi-synthetic DNA.

An "isolated nucleic acid molecule" or "isolated nucleic acid fragment" refers to the phosphate ester polymeric form of ribonucleosides (adenosine, guanosine, uridine or cytidine; "RNA molecules") or deoxyribonucleosides (deoxyadenosine, deoxyguanosine, deoxythymidine, or deoxycytidine; "DNA molecules"), or any phosphoester analogs thereof, such as phosphorothioates and thioesters, in either single stranded form, or a double-stranded helix. Double stranded DNA-DNA, DNA-RNA and RNA-RNA helices are possible. The term nucleic acid molecule, and in particular DNA or RNA molecule, refers only to the primary and secondary structure of the molecule, and does not limit it to any particular tertiary forms. Thus, this term includes double-stranded DNA found, inter alia, in linear or circular DNA molecules (e.g., restriction fragments), plasmids, and chromosomes. In discussing the structure of particular double-stranded DNA molecules, sequences may be described herein according to the normal convention of giving only the sequence in the 5' to 3' direction along the non-transcribed strand of DNA (i.e., the strand having a sequence homologous to the mRNA).

A "gene" refers to an assembly of nucleotides that encode a polypeptide, and includes cDNA and genomic DNA nucleic acids. "Gene" also refers to a nucleic acid fragment that expresses a specific protein, including intervening sequences (introns) between individual coding segments (exons), as well as regulatory sequences preceding (5' non-coding sequences) and following (3' non-coding sequences) the coding sequence. "Native gene" refers to a gene as found in nature with its own regulatory sequences.

A nucleic acid molecule is "hybridizable" to another nucleic acid molecule, such as a cDNA, genomic DNA, or RNA, when a single stranded form of the nucleic acid molecule can anneal to the other nucleic acid molecule under the appropriate conditions of temperature and solution ionic strength. Hybridization and washing conditions are well known and exemplified, e.g., in Sambrook, J., Fritsch, E. F. and Maniatis, T. MOLECULAR CLONING: A LABORATORY MANUAL, Second Edition, Cold Spring Harbor Laboratory Press, Cold Spring Harbor (1989), particularly Chapter 11 and Table 11.1 therein (hereinafter "Maniatis", entirely incorporated herein by reference). The conditions of temperature and ionic strength determine the "stringency" of the hybridization. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions. One set of conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. For more stringent conditions, washes are performed at higher temperatures in which the washes are identical to those above except for the temperature of the final two 30 min washes in 0.2×SSC, 0.5% SDS are increased to 60° C. Another set of highly stringent conditions uses two final washes in 0.1×SSC, 0.1% SDS at 65° C. An additional set of highly stringent conditions are defined by hybridization at 0.1×SSC, 0.1% SDS, 65° C. and washed with 2×SSC, 0.1% SDS followed by 0.1×SSC, 0.1% SDS.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see. e.g., Maniatis at 9.50-9.51). For hybridizations with shorter nucleic acids, i.e., oligonucleotides, the position of mismatches becomes more important, and the length of the oligonucleotide determines its specificity (see. e.g., Maniatis, at 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least 30 nucleotides. Furthermore, the skilled artisan will recognize that the temperature and wash solution salt concentration may be adjusted as necessary according to factors such as length of the probe.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences.

As known in the art, "similarity" between two polypeptides is determined by comparing the amino acid sequence and conserved amino acid substitutes thereto of the polypeptide to the sequence of a second polypeptide.

"Identity" and "similarity" can be readily calculated by known methods, including but not limited to those described in: Computational Molecular Biology (Lesk. A. M., ed.) Oxford University Press, NY (1988); Biocomputing: Informatics and Genome Projects (Smith, D. W., ed.) Academic Press, NY (1993); Computer Analysis of Sequence Data, Part I (Griffin, A. M., and Griffin, H. G., eds.) Humana Press, NJ (1994); Sequence Analysis in Molecular Biology (von Heinje, G., ed.) Academic Press (1987); and Sequence Analysis Primer (Gribskov, M. and Devereux, J., eds.) Stockton Press, NY (1991). Preferred methods to determine identity are designed to give the best match between the sequences tested. Methods to determine identity and similarity are codified in publicly available computer programs. Sequence alignments and percent identity calculations may be performed using the Megalign program of the LASERGENE bioinformatics computing suite (DNASTAR Inc., Madison, Wis.). Multiple alignments of the sequences disclosed herein were performed using the Clustal method of alignment (Higgins and Sharp (1989) CABIOS. 5:151-153) with the default parameters (GAP PENALTY=10, GAP LENGTH PENALTY=10). Default parameters for pairwise alignments using the Clustal method were KTUPLE 1, GAP PENALTY=3. WINDOW=5 and DIAGONALS SAVED=5.

Suitable nucleic acid sequences or fragments thereof (isolated polynucleotides of the present invention) encode polypeptides that are at least about 70% to 75% identical to the amino acid sequences reported herein, at least about 80%, 85%, or 90% identical to the amino acid sequences reported herein, or at least about 95%, 96%, 97%, 98%, 99%, or 100% identical to the amino acid sequences reported herein. Suitable nucleic acid fragments are at least about 70%, 75%, or 80% identical to the nucleic acid sequences reported herein, at least about 80%, 85%, or 90% identical to the nucleic acid sequences reported herein, or at least about 95%, 96%, 97%, 98%, 99%, or 100% identical to the nucleic acid sequences reported herein. Suitable nucleic acid fragments not only have the above identities/similarities but typically encode a polypeptide having at least 50 amino acids, at least 100 amino acids, at least 150 amino acids, at least 200 amino acids, or at least 250 amino acids.

A DNA or RNA "coding region" is a DNA or RNA molecule which is transcribed and/or translated into a polypeptide in a cell in vitro or in vivo when placed under the control of appropriate regulatory sequences. "Suitable regulatory regions" refer to nucleic acid regions located upstream (5' non-coding sequences), within, or downstream (3' non-coding sequences) of a coding region, and which influence the transcription, RNA processing or stability, or translation of the associated coding region. Regulatory regions may include promoters, translation leader sequences. RNA processing site, effector binding site and stem-loop structure. The boundaries of the coding region are determined by a start codon at the 5' (amino) terminus and a translation stop codon at the 3' (carboxyl) terminus. A coding region can include, but is not limited to, prokaryotic regions, cDNA from mRNA, genomic DNA molecules, synthetic DNA molecules, or RNA molecules. If the coding region is intended for expression in a eukaryotic cell, a polyadenylation signal and transcription termination sequence will usually be located 3' to the coding region.

An "isoform" is a protein that has the same function as another protein but which is encoded by a different gene and may have small differences in its sequence.

A "paralogue" is a protein encoded by a gene related by duplication within a genome.

An "orthologue" is gene from a different species that has evolved from a common ancestral gene by speciation. Normally, orthologues retain the same function in the course of evolution as the ancestral gene.

"Open reading frame" is abbreviated ORF and means a length of nucleic acid, either DNA, cDNA or RNA, that comprises a translation start signal or initiation codon, such as an ATG or AUG, and a termination codon and can be potentially translated into a polypeptide sequence.

"Promoter" refers to a DNA fragment capable of controlling the expression of a coding sequence or functional RNA. In general, a coding region is located 3' to a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity. A promoter is generally bounded at its 3' terminus by the transcription initiation site and extends upstream (5' direction) to include the minimum number of bases or elements necessary to initiate transcription at levels detectable above background. Within the promoter will be found a transcription initiation site (conveniently defined for example, by mapping with nuclease S1), as well as protein binding domains (consensus sequences) responsible for the binding of RNA polymerase.

A coding region is "under the control" of transcriptional and translational control elements in a cell when RNA polymerase transcribes the coding region into mRNA, which is then trans-RNA spliced (if the coding region contains introns) and translated into the protein encoded by the coding region.

"Transcriptional and translational control regions" are DNA regulatory regions, such as promoters, enhancers, terminators, and the like, that provide for the expression of a coding region in a host cell. In eukaryotic cells, polyadenylation signals are control regions.

The term "operably associated" refers to the association of nucleic acid sequences on a single nucleic acid fragment so that the function of one is affected by the other. For example, a promoter is operably associated with a coding region when it is capable of affecting the expression of that coding region (i.e., that the coding region is under the transcriptional control of the promoter). Coding regions can be operably associated to regulatory regions in sense or antisense orientation.

The term "expression," as used herein, refers to the transcription and stable accumulation of sense (mRNA) or antisense RNA derived from the nucleic acid fragment of the invention. Expression may also refer to translation of mRNA into a polypeptide.

The term "lignocellulose" refers to material that is comprised of lignin and cellulose.

A "cellulolytic enzyme" can be any enzyme involved in cellulose digestion, metabolism and/or hydrolysis. The term "cellulase" refers to a class of enzymes produced chiefly by fungi, bacteria, and protozoans that catalyze cellulolysis (i.e. the hydrolysis) of cellulose. However, there are also cellulases produced by other types of organisms such as plants and animals. Several different kinds of cellulases are known, which differ structurally and mechanistically. There are general types of cellulases based on the type of reaction catalyzed: endocellulase breaks internal bonds to disrupt the crystalline structure of cellulose and expose individual cellulose polysaccharide chains; exocellulase cleaves 2-4 units from the ends of the exposed chains produced by endocellulase, resulting in the tetrasaccharides or disaccharide such as cellobiose. There are two main types of exocellulases (or cellobiohydrolases, abbreviate CBH)—one type working processively from the reducing end, and one type working processively from the non-reducing end of cellulose; cellobiase or beta-glucosidase hydrolyses the exocellulase product into individual monosaccharides; oxidative cellulases that depolymerize cellulose by radical reactions, as for instance cellobiose dehydrogenase (acceptor); cellulose phosphorylases that depolymerize cellulose using phosphates instead of water. In the most familiar case of cellulase activity, the enzyme complex breaks down cellulose to beta-glucose. A "cellulase" can be any enzyme involved in cellulose digestion, metabolism and/or hydrolysis, including an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, and feruoyl esterase protein.

An "amylolytic enzyme" can be any enzyme involved in amylase digestion, metabolism and/or hydrolysis. The term "amylase" refers to an enzyme that breaks starch down into sugar. Amylase is present in human saliva, where it begins the chemical process of digestion. Foods that contain much starch but little sugar, such as rice and potato, taste slightly sweet as they are chewed because amylase turns some of their starch into sugar in the mouth. The pancreas also makes amylase ($\alpha$-amylase) to hydrolyse dietary starch into disaccharides and trisaccharides which are converted by other enzymes to glucose to supply the body with energy. Plants and some bacteria also produce amylase. All amylases are glycoside hydrolases and act on $\alpha$-1,4-glycosidic bonds.

Some amylases, such as γ-amylase (glucoamylase), also act on α-1,6-glycosidic bonds. Amylase enzymes include α-amylase (EC 3.2.1.1), β-amylase (EC 3.2.1.2), and γ-amylase (EC 3.2.1.3). The α-amylases are calcium metalloenzymes, unable to function in the absence of calcium. By acting at random locations along the starch chain, α-amylase breaks down long-chain carbohydrates, ultimately yielding maltotriose and maltose from amylose, or maltose, glucose and "limit dextrin" from amylopectin. Because it can act anywhere on the substrate, α-amylase tends to be faster-acting than 3-amylase. In animals, it is a major digestive enzyme and its optimum pH is about 6.7-7.0. Another form of amylase, β-amylase is also synthesized by bacteria, fungi, and plants. Working from the non-reducing end, β-amylase catalyzes the hydrolysis of the second α-1,4 glycosidic bond, cleaving off two glucose units (maltose) at a time. Many microbes produce amylase to degrade extracellular starches. In addition to cleaving the last α(1-4)glycosidic linkages at the nonreducing end of amylose and amylopectin, yielding glucose, γ-amylase will cleave α(1-6) glycosidic linkages. Another amylolytic enzyme is alpha-glucosidase that acts on maltose and other short malto-oligosaccharides produced by alpha-, beta-, and gamma-amylases, converting them to glucose. Another amylolytic enzyme is pullulanase. Pullulanase is a specific kind of glucanase, an amylolytic exoenzyme, that degrades pullulan. Pullulan is regarded as a chain of maltotriose units linked by alpha-1,6-glycosidic bonds. Pullulanase (EC 3.2.1.41) is also known as pullulan-6-glucanohydrolase (Debranching enzyme). Another amylolytic enzyme, isopullulanase, hydrolyses pullulan to isopanose (6-alpha-malto-sylglucose). Isopullulanase (EC 3.2.1.57) is also known as pullulan 4-glucanohydrolase. An "amylase" can be any enzyme involved in amylase digestion, metabolism and/or hydrolysis, including α-amylase, β-amylase, glucoamylase, pullulanase, isopullulanase, and alpha-glucosidase.

The term "xylanolytic activity" is intended to include the ability to hydrolyze glycosidic linkages in oligopentoses and polypentoses. The term "xylanase" is the name given to a class of enzymes which degrade the linear polysaccharide beta-1,4-xylan into xylose, thus breaking down hemicellulose, one of the major components of plant cell walls. As such, it plays a major role in micro-organisms thriving on plant sources (mammals, conversely, do not produce xylanase). Additionally, xylanases are present in fungi for the degradation of plant matter into usable nutrients. Xylanases include those enzymes that correspond to Enzyme Commission Number 3.2.1.8. A "xylose metabolizing enzyme" can be any enzyme involved in xylose digestion, metabolism and/or hydrolysis, including a xylose isomerase, xylulokinase, xylose reductase, xylose dehydrogenase, xylitol dehydrogenase, xylonate dehydratase, xylose transketolase, and a xylose transaldolase protein.

The term "pectinase" is a general term for enzymes, such as pectolyase, pectozyme and polygalacturonase, commonly referred to in brewing as pectic enzymes. These enzymes break down pectin, a polysaccharide substrate that is found in the cell walls of plants. One of the most studied and widely used commercial pectinases is polygalacturonase. Pectinases are commonly used in processes involving the degradation of plant materials, such as speeding up the extraction of fruit juice from fruit, including apples and sapota. Pectinases have also been used in wine production since the 1960s.

A "saccharolytic enzyme" can be any enzyme involved in carbohydrate digestion, metabolism and/or hydrolysis, including amylases, cellulases, hemicellulases, cellulolytic and amylolytic accessory enzymes, inulinases, levanases, and pentose sugar utilizing enzymes.

A "pentose sugar utilizing enzyme" can be any enzyme involved in pentose sugar digestion, metabolism and/or hydrolysis, including xylanase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

Host Cells Expressing Heterologous Saccharolytic Enzymes

In order to address the limitations of the previous systems, in one aspect, the present invention provides host cells expressing heterologous cellulases that can be effectively and efficiently utilized to produce products such as ethanol from cellulose. In another embodiment, the host cells express heterologous amylases that can be effectively and efficiently utilized to produce products such as ethanol from biomass feedstock, such as grain feedstock. In yet another embodiment, the host cells express heterologous enzymes that utilize pentose sugars.

In some embodiments, the host cell can be a yeast. According to the present invention the yeast host cell can be, for example, from the genera *Saccharomyces, Kluyveromyces, Candida, Pichia, Schizosaccharomyces, Hansenula, Kloeckera, Schwanniomyces,* and *Yarrowia.* Yeast species as host cells can include, for example, *S. cerevisiae, S. bulderi, S. barnetti, S. exiguus, S. uvarum, S. diastaticus, K. lactis, K. marxianus,* or *K. fragilis.* In some embodiments, the yeast is selected from the group consisting of *Saccharomyces cerevisiae, Schizzosaccharomyces pombe, Candida albicans, Pichia pastoris, Pichia stipilis, Yarrowia lipolytica, Hansenula polymorpha, Phaffia rhodozyma, Candida utilis, Arxula adeninivorans, Debaryomyces hansenii, Debaryomyces polymorphus, Schizosaccharomyces pombe* and *Schwanniomyces occidentalis.* In one particular embodiment, the yeast is *Saccharomyces cerevisiae.* The selection of an appropriate host is deemed to be within the scope of those skilled in the art from the teachings herein.

In some embodiments of the present invention, the host cell is an oleaginous cell. According to the present invention, the oleaginous host cell can be an oleaginous yeast cell. For example, the oleaginous yeast host cell can be from the genera *Blakeslea, Candida, Cryptococcus, Cunninghamella, Lipomyces, Mortierella, Mucor, Phycomyces, Pythium, Rhodosporidum, Rhodotorula, Trichosporon* or *Yarrowia.* According to the present invention, the oleaginous host cell can be an oleaginous microalgae host cell. For example, the oleaginous microalgea host cell can be from the genera *Thraustochytrium* or *Schizochytrium.*

In some embodiments of the present invention, the host cell is a thermotolerant host cell. Thermotolerant host cells can be particularly useful in simultaneous saccharification and fermentation processes by allowing externally produced cellulases and ethanol-producing host cells to perform optimally in similar temperature ranges.

Thermotolerant host cells of the invention can include, for example, *Issatchenkia orientalis, Pichia mississippiensis, Pichia mexicana, Pichia farinosa, Clavispora opuntiae, Clavispora lusitaniae, Candida mexicana, Hansenula polymorpha* and *Kluyveromyces* host cells.

In some particular embodiments of the present invention, the host cell is a *Kluyveromyces* host cell. For example, the *Kluyveromyces* host cell can be a *K. lactis, K marxianus, K. blattae, K. phaffii, K. yarrowii, K. aestuarii, K. dobzhanskii, K. wickerhamii, K. thermotolerans,* or *K. waltii* host cell. In one embodiment, the host cell is a *K. lactis*, or *K. marxianus* host cell. In another embodiment, the host cell is a *K. marxianus* host cell.

In some embodiments of the present invention the thermotolerant host cell can grow at temperatures above about 30° C., about 31° C. about 32° C., about 33° C., about 34° C., about 35° C., about 36° C., about 37° C. about 38° C., about 39° C., about 40° C., about 41° C. or about 42° C. In some embodiments of the present invention the thermotolerant host cell can produce ethanol from cellulose at temperatures above about 30° C. about 31° C., about 32° C., about 33° C., about 34° C., about 35° C. about 36° C. about 37° C., about 38° C., about 39° C. about 40° C., about 41° C., about 42° C., or about 50° C.

In some embodiments of the present invention, the thermotolerant host cell can grow at temperatures from about 30° C. to 60° C., about 30° C. to 55° C. about 30° C. to 50° C., about 40° C. to 60° C., about 40° C. to 55° C. or about 40° C. to 50° C. In some embodiments of the present invention, the thermotolterant host cell can produce ethanol from cellulose at temperatures from about 30° C. to 60° C., about 30° C. to 55° C., about 30° C. to 50° C., about 40° C. to 60° C., about 40° C. to 55° C. or about 40° C. to 50° C.

Host cells are genetically engineered (transduced or transformed or transfected) with the polynucleotides encoding saccharolytic enzymes (amylases, cellulases, hemicellulases, cellulolytic and amylolytic accessory enzymes, inulinases, levanases, pentose sugar hydrolases and others) of this invention which are described in more detail herein. The polynucleotides encoding saccharolytic enzymes can be introduced to the host cell on a vector of the invention, which may be, for example, a cloning vector or an expression vector comprising a sequence encoding a heterologous saccharolytic enzyme. The host cells can comprise polynucleotides of the invention as integrated copies or plasmid copies.

In certain aspects, the present invention relates to host cells containing the polynucleotide constructs described herein. In one embodiment, the host cells of the present invention express one or more heterologous polypeptides of saccharolytic enzymes. In some embodiments, the host cell comprises a combination of polynucleotides that encode heterologous saccharolytic enzymes or fragments, variants or derivatives thereof. The host cell can, for example, comprise multiple copies of the same nucleic acid sequence, for example, to increase expression levels, or the host cell can comprise a combination of unique polynucleotides. In other embodiments, the host cell comprises a single polynucleotide that encodes a heterologous saccharolytic enzyme or a fragment, variant or derivative thereof. In particular, such host cells expressing a single heterologous saccharolytic enzyme can be used in co-culture with other host cells of the invention comprising a polynucleotide that encodes at least one other heterologous saccharolytic enzyme or fragment, variant or derivative thereof.

Introduction of a polynucleotide encoding a heterologous saccharolytic enzyme into a host cell can be done by methods known in the art. Introduction of polynucleotides encoding heterologous saccharolytic enzyme into, for example yeast host cells, can be effected by lithium acetate transformation, spheroplast transformation, or transformation by electroporation, as described in Current Protocols in Molecular Biology, 13.7.1-13.7.10. Introduction of the construct in other host cells can be effected by calcium phosphate transfection, DEAE-Dextran mediated transfection, or electroporation. (Davis, L., et al., Basic Methods in Molecular Biology, (1986)).

The transformed host cells or cell cultures, as described above, can be examined for protein content of an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase protein, alpha-amylase, beta-amylase, glucoamylase, pullulanase, isopullulanase, alpha-glucosidase, beta-glucosidase, arabinase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase. For the use of secreted heterologous saccharolytic enzymes, protein content can be determined by analyzing the host (e.g., yeast) cell supernatants. In certain embodiments, high molecular weight material can be recovered from the yeast cell supernatant either by acetone precipitation or by buffering the samples with disposable de-salting cartridges. Proteins, including tethered heterologous saccharolytic enzymes, can also be recovered and purified from recombinant yeast cell cultures by methods including spheroplast preparation and lysis, cell disruption using glass beads, and cell disruption using liquid nitrogen for example. Additional protein purification methods include ammonium sulfate or ethanol precipitation, acid extraction, anion or cation exchange chromatography, phosphocellulose chromatography, hydrophobic interaction chromatography, affinity chromatography, hydroxylapatite chromatography, gel filtration, and lectin chromatography. Protein refolding steps can be used, as necessary, in completing configuration of the mature protein. Finally, high performance liquid chromatography (HPLC) can be employed for final purification steps.

Protein analysis methods include methods such as the traditional Lowry method, the BCA assay, absorbance at 280 nm, or the protein assay method according to BioRad's manufacturer's protocol. Using such methods, the protein content of saccharolytic enzymes can be estimated. Additionally, to accurately measure protein concentration a heterologous cellulase can be expressed with a tag, for example a His-tag or HA-tag and purified by standard methods using, for example, antibodies against the tag, a standard nickel resin purification technique or similar approach.

The transformed host cells or cell cultures, as described above, can be further analyzed for hydrolysis of cellulose, or starch, or pentose sugar utilization (e.g., by a sugar detection assay), for a particular type of saccharolytic enzyme activity (e.g., by measuring the individual endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase) or for total cellulase activity. Endoglucanase activity can be determined, for example, by measuring an increase of reducing ends in an endoglucanase specific CMC or hydroxyethylcellulose (HEC) substrate. Cellobiohydrolase activity can be measured, for example, by using insoluble cellulosic substrates such as the amorphous substrate phosphoric acid swollen cellulose (PASC) or microcrystalline cellulose (Avicel) and determining the extent of the substrate's hydrolysis. β-glucosidase activity can be measured by a variety of assays, e.g., using cellobiose. Assays for activity of other saccharolytic enzyme types are known in the art and are exemplified below.

A total saccharolytic enzyme activity, which can include the activity of endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase protein, alpha-amylase, beta-amylase, glucoamylase, alpha-glucosidase, beta-glucosidase, galactosidase, arabinase, arabinoxylanase, arabinosidase, arabinofuranosidase, arabinoxylanase, arabinosidase, pullulanase, isopullulanase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase can hydrolyze biomass feedstocks synergistically. For example, total cellulase activity can thus be measured using insoluble substrates including pure cellulosic substrates such as Whatman No. 1 filter paper, cotton linter, microcrystalline cellulose, bacterial cellulose, algal cellulose, and cellulose-containing substrates such as dyed cellulose, alpha-cellulose or pretreated lignocellulose. Specific activity of cellulases can also be detected by methods known to one of ordinary skill in the art, such as by the Avicel assay (described supra) that would be normalized by protein (cellulase) concentration measured for the sample. Total saccharolytic activity could be also measured using complex substrate containing starch, cellulose and hemicellulose such as corn mash by measuring released monomeric sugars. In such an assay different groups of enzymes could work in "indirect" when one group of enzymes such as cellulases can make substrate for another group of enzymes such as amylases more accessible through hydrolysis of cellulolytic substrate around amylolytic substrate. This mechanism can also work vice versa.

One aspect of the invention is thus related to the efficient production of saccharolytic enzymes to aid in the digestion and utilization of starch, cellulose, and pentose sugars, and generation of products such as ethanol. A "saccharolytic enzyme" can be any enzyme involved in carbohydrate digestion, metabolism and/or hydrolysis, including amylases, cellulases, hemicellulases, cellulolytic and amylolytic accessory enzymes, inulinases, levanases, and pentose sugar hydrolasing enzymes. A "cellulase" can be any enzyme involved in cellulase digestion, metabolism and/or hydrolysis, including an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, and feruoyl esterase protein. An "amylase" can be any enzyme involved in amylase digestion and/or metabolism, including alpha-amylase, beta-amylase, glucoamylase, pullulanase, isopullulanase, and alpha-glucosidase. A pentose sugar hydrolyzing enzyme can be any enzyme involved in pentose sugar digestion, and/or metabolism, including xylanase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

In additional embodiments, the transformed host cells or cell cultures are assayed for ethanol production. Ethanol production can be measured by techniques known to one or ordinary skill in the art, e.g., by a standard HPLC refractive index method.

Heterologous Saccharolytic Enzymes

According to one aspect of the present invention, the expression of heterologous saccharolytic enzymes in a host cell can be used advantageously to produce products such as ethanol from biomass sources. For example, cellulases from a variety of sources can be heterologously expressed to successfully increase efficiency of ethanol production.

The saccharolytic enzymes can be from fungi, yeast, bacteria, plant, protozoan or termite sources. In some embodiments, the saccharolytic enzyme is from *H. grisea, T. aurantiacus. T. emersonii, T. reesei, C. lacteus, C. formosanus, N. takasagoensis, C. acinaciformis, M. darwinensis, N. walkeri. S. fibuligera. C. luckowense R. speratus, Thermobfida fusca, Clostridum thermocellum, Clostridium cellulolyticum, Clostridum josui, Bacillus pumilis, Cellulomonas fimi, Saccharophagus degradans, Piromyces equii, Neocallimastix patricarum* or *Arabidopsis thaliana*.

In some embodiments, the cellulase of the invention is any cellulase disclosed in Table 4 or Table 7 produced herein. In some embodiments, the cellulase is encoded by a nucleic acid sequence at least about 80%, at least about 85%, at least about 90%, at least about 95%, at least about 96%, at least about 97%, at least about 98%, at least about 99%, or 100% identical to any one of SEQ ID NOs: 1-218. In some embodiments, the cellulase has an amino acid sequence that is at least about 80%, at least about 85%, at least about 90%, at least about 95%, at least about 96%, at least about 97%, at least about 98%, at least about 99%, or 100% identical to any one of SEQ ID NOs: 219-436. In some embodiments, the cellulase of the invention is any cellulase suitable for expression in an appropriate host cell.

In other embodiments, the amylase of the invention is any amylase disclosed in Table 19 produced herein. In some embodiments, the amylase is encoded by a nucleic acid sequence at least about 80%, at least about 85%, at least about 90%, at least about 95%, at least about 96%, at least about 97%, at least about 98%, at least about 99%, or 100% identical to any one of SEQ ID NOs: 437-441. In some embodiments, the cellulase has an amino acid sequence that is at least about 80%, at least about 85%, at least about 90%, at least about 95%, at least about 96%, at least about 97%, at least about 98%, at least about 99%, or 100% identical to any one of SEQ ID NOs: 442-446. In some embodiments, the amylase of the invention is any amylase suitable for expression in an appropriate host cell.

In some embodiments of the invention, multiple saccharolytic enzymes from a single organism are co-expressed in the same host cell. In some embodiments of the invention, multiple saccharolytic enzymes from different organisms are co-expressed in the same host cell. In particular, saccharolytic enzymes from two, three, four, five, six, seven, eight, nine or more organisms can be co-expressed in the same host cell. Similarly, the invention can encompass co-cultures of yeast strains, wherein the yeast strains express different saccharolytic enzymes. Co-cultures can include yeast strains expressing heterologous saccharolytic enzymes from the same organisms or from different organisms. Co-cultures can include yeast strains expressing saccharolytic enzymes from two, three, four, five, six, seven, eight, nine or more organisms.

Lignocellulases of the present invention include both endoglucanases and exoglucanases. Other lignocellulases of the invention include accessory enzymes which can act on the lignocellulosic material. The lignocellulases can be, for example, endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, and feruoyl esterases. In some embodiments, the lignocellulases of the invention can be any suitable enzyme for digesting the desired lignocellulosic material.

In certain embodiments of the invention, the lignocellulase can be an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, and feruoyl esterase paralogue or orthologue. In particular embodiments, the lignocellulase is derived from any species named in Tables 4 and 7. In one particular embodiment, the lignocellulase comprises an amino acid sequence selected from SEQ ID NOs: 219-436. In certain other embodiments, the lignocellulase comprises an amino acid sequence that is at least about 70, about 80, about 90, about 95, about 96, about 97, about 98, about 99, or 100% identical to an amino acid sequence selected from SEQ ID NOs: 219-436.

In other embodiments of the invention, the amylases can be alpha-amylases, beta-amylases, glucoamylases, alpha-glucosidases, pullulanase, or isopullulanase paralogues or orthologues.

As a practical matter, whether any polypeptide is at least 70%, 80%, 85%, 90%, 95%, 96%, 97%, 98%, 99% or 100% identical to a polypeptide of the present invention can be determined conventionally using known computer programs. Methods for determining percent identity, as discussed in more detail below in relation to polynucleotide identity, are also relevant for evaluating polypeptide sequence identity.

In some particular embodiments of the invention, the saccharolytic enzyme comprises a sequence selected from the saccharolytic enzymes disclosed in Table 4, or Table 7, or Table 19 presented herein. The saccharolytic enzymes of the invention also include saccharolytic enzymes that comprise a sequence at least about 70, about 80, about 90, about 95, about 96, about 97, about 98, about 99 or 100% identical to the sequences of Table 4, or Table 7, or Table 19. Amino acid and nucleic acid sequences are readily determined for a gene, protein or other element by a accession number upon consulting the proper database, for example Genebank. However, sequences for the genes and proteins of the present invention are also disclosed herein (SEQ ID NOs: 1-445).

Some embodiments of the invention encompass a polypeptide comprising at least 10, 20, 30, 40, 50, 60, 70, 80, 90, 100, 200, 300, 400, or 500 or more consecutive amino acids of any of SEQ ID NOs: 219-445, or domains, fragments, variants, or derivatives.

In certain aspects of the invention, the polypeptides and polynucleotides of the present invention are provided in an isolated form, e.g., purified to homogeneity.

The present invention also encompasses polypeptides which comprise, or alternatively consist of, an amino acid sequence which is at least about 80%, 85%, 90%, 95%, 96%, 97%, 98%, 99% similar to the polypeptide of any of SEQ ID NOs: 219-436, or SEQ ID NOs: 442-446, and to portions of such polypeptide with such portion of the polypeptide generally containing at least 30 amino acids and more preferably at least 50 amino acids.

As known in the art "similarity" between two polypeptides is determined by comparing the amino acid sequence and conserved amino acid substitutes thereto of the polypeptide to the sequence of a second polypeptide.

The present invention further relates to a domain, fragment, variant, derivative, or analog of the polypeptide of any of SEQ ID NOs: 219-436, or SEQ ID NOs: 442-446.

Fragments or portions of the polypeptides of the present invention can be employed for producing the corresponding full-length polypeptide by peptide synthesis. Therefore, the fragments can be employed as intermediates for producing the full-length polypeptides.

Fragments of lignocellulases of the invention encompass domains, proteolytic fragments, deletion fragments and in particular, fragments of any of the genes named in Tables 4 and 7, which retain any specific biological activity of the endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, and feruoyl esterase proteins. Polypeptide fragments further include any portion of the polypeptide which retains a catalytic activity of endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, and feruoyl esterase protein.

Fragments of amylases of the invention encompass domains, proteolytic fragments, deletion fragments and in particular, fragments of any of the genes named in Tables 15, 16, and 19, which retain any specific biological activity of the alpha-amylase, beta-amylase, glucoamylase, pullulanase, isopullulanase, and alpha-glucosidase proteins. Polypeptide fragments further include any portion of the polypeptide which retains a catalytic activity of alpha-amylase, beta-amylase, glucoamylase, pullulanase, isopullulanase, and alpha-glucosidase protein.

The variant, derivative or analog of the polypeptide of any of SEQ ID NOs: 219-436, or SEQ ID NOs: 442-446 may be (i) one in which one or more of the amino acid residues are substituted with a conserved or non-conserved amino acid residue (preferably a conserved amino acid residue) and such substituted amino acid residue may or may not be one encoded by the genetic code, or (ii) one in which one or more of the amino acid residues includes a substituent group, or (iii) one in which the mature polypeptide is fused with another compound, such as a compound to increase the half-life of the polypeptide (for example, polyethylene glycol), or (iv) one in which the additional amino acids are fused to the mature polypeptide for purification of the polypeptide or (v) one in which a fragment of the polypeptide is soluble, i.e., not membrane bound, yet still binds ligands to the membrane bound receptor. Such variants, derivatives and analogs are deemed to be within the scope of those skilled in the art from the teachings herein.

The polypeptides of the present invention further include variants of the polypeptides. A "variant" of the polypeptide can be a conservative variant, or an allelic variant. As used herein, a conservative variant refers to alterations in the amino acid sequence that do not adversely affect the biological functions of the protein. A substitution, insertion or deletion is said to adversely affect the protein when the altered sequence prevents or disrupts a biological function associated with the protein. For example, the overall charge, structure or hydrophobic-hydrophilic properties of the protein can be altered without adversely affecting a biological activity. Accordingly, the amino acid sequence can be altered, for example to render the peptide more hydrophobic or hydrophilic, without adversely affecting the biological activities of the protein.

By an "allelic variant" is intended alternate forms of a gene occupying a given locus on a chromosome of an organism. Genes II, Lewin, B., ed., John Wiley & Sons, New York (1985). Non-naturally occurring variants may be produced using art-known mutagenesis techniques. Allelic variants, though possessing a slightly different amino acid sequence than those recited above, will still have the same or similar biological functions associated with the endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterases, alpha-amylase, beta-amylase, glucoamylase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase of the invention. The allelic variants, the conservative substitution variants, and members of the endoglucanase, cellobiohydrolase, β-glucosidase, alpha-amylase, beta-amylase, glucoamylase, pullulanase, isopullulanase, or alpha-glucosidase protein families, can have an amino acid sequence having at least 75%, at least 80%, at least 90%, at least 95% amino acid sequence identity with endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterase, alpha-amylase, beta-amylase, glucoamylase, pullulanase, isopullulanase, alpha-glucosidase, and beta-glucosidase amino acid sequence set forth in any one of SEQ ID NOs: 219-436, and SEQ ID NOs: 442-446. Identity or homology with respect to such sequences is defined herein as the percentage of amino acid residues in the candidate sequence that are identical with the known peptides, after aligning the sequences and introducing gaps, if necessary, to achieve the maximum percent homology, and not considering any conservative substitutions as part of the sequence identity. N-terminal, C-terminal or internal extensions, deletions, or insertions into the peptide sequence shall not be construed as affecting homology.

Thus, in one aspect the proteins and peptides of the present invention include molecules comprising the amino acid sequence of SEQ ID NOs: 219-436, or and SEQ ID NOs: 442-446 or fragments thereof having a consecutive sequence of at least about 3, 4, 5, 6, 10, 15, 20, 25, 30, 35 or more amino acid residues of the endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, and beta-glucosidase polypeptide sequences; amino acid sequence variants of such sequences wherein at least one amino acid residue has been inserted N- or C-terminal to, or within, the disclosed sequence; amino acid sequence variants of the disclosed sequences, or their fragments as defined above, that have been substituted by another residue. Contemplated variants further include those containing predetermined mutations by, e.g., homologous recombination, site-directed or PCR mutagenesis, and the corresponding proteins of other animal species, including but not limited to bacterial, fungal, insect, rabbit, rat, porcine, bovine, ovine, equine and non-human primate species, the alleles or other naturally occurring variants of the family of proteins; and derivatives wherein the protein has been covalently modified by substitution, chemical, enzymatic, or other appropriate means with a moiety other than a naturally occurring amino acid (for example, a detectable moiety such as an enzyme or radioisotope).

Using known methods of protein engineering and recombinant DNA technology, variants may be generated to improve or alter the characteristics of the polypeptides of saccharolytic enzymes. For instance, one or more amino acids can be deleted from the N-terminus or C-terminus of the secreted protein without substantial loss of biological function.

Thus, in another aspect the invention further includes endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptide variants which show substantial biological activity. Such variants include deletions, insertions, inversions, repeats, and substitutions selected according to general rules known in the art so as have little effect on activity.

The skilled artisan is fully aware of amino acid substitutions that are either less likely or not likely to significantly effect protein function (e.g., replacing one aliphatic amino acid with a second aliphatic amino acid), as further described below.

For example, guidance concerning how to make phenotypically silent amino acid substitutions is provided in Bowie et al., "Deciphering the Message in Protein Sequences: Tolerance to Amino Acid Substitutions," *Science* 247:1306-1310

(1990), wherein the authors indicate that there are two main strategies for studying the tolerance of an amino acid sequence to change.

The first strategy exploits the tolerance of amino acid substitutions by natural selection during the process of evolution. By comparing amino acid sequences in different species, conserved amino acids can be identified. These conserved amino acids are likely important for protein function. In contrast, the amino acid positions where substitutions have been tolerated by natural selection indicates that these positions are not critical for protein function. Thus, positions tolerating amino acid substitution could be modified while still maintaining biological activity of the protein.

The second strategy uses genetic engineering to introduce amino acid changes at specific positions of a cloned gene to identify regions critical for protein function. For example, site directed mutagenesis or alanine-scanning mutagenesis (introduction of single alanine mutations at every residue in the molecule) can be used. (Cunningham and Wells, *Science* 244:1081-1085 (1989).) The resulting mutant molecules can then be tested for biological activity.

As the authors state, these two strategies have revealed that proteins are often surprisingly tolerant of amino acid substitutions. The authors further indicate which amino acid changes are likely to be permissive at certain amino acid positions in the protein. For example, most buried (within the tertiary structure of the protein) amino acid residues require nonpolar side chains, whereas few features of surface side chains are generally conserved. Moreover, tolerated conservative amino acid substitutions involve replacement of the aliphatic or hydrophobic amino acids Ala, Val, Leu and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp, and replacement of the small-sized amino acids Ala, Ser, Thr, Met, and Gly.

The terms "derivative" and "analog" refer to a polypeptide differing from the endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptides as disclosed herein, but retaining essential properties thereof. Generally, derivatives and analogs are overall closely similar, and, in many regions, identical to the endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptides disclosed herein. The terms "derivative" and "analog" when referring to endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptides include any polypeptides which retain at least some of the activity of the corresponding native polypeptide, e.g., the exoglucanase activity, or the activity of the its catalytic domain.

Derivatives of the saccharolytic enzymes disclosed herein, are polypeptides which have been altered so as to exhibit features not found on the native polypeptide. Derivatives can be covalently modified by substitution, chemical, enzymatic, or other appropriate means with a moiety other than a naturally occurring amino acid (for example, a detectable moiety such as an enzyme or radioisotope). Examples of derivatives include fusion proteins.

An analog is another form of an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptide of the present invention. An "analog" also retains substantially the same biological function or activity as the polypeptide of interest, e.g., functions as a xylanase. An analog includes a proprotein which can be activated by cleavage of the proprotein portion to produce an active mature polypeptide.

The polypeptide of the present invention may be a recombinant polypeptide, a natural polypeptide or a synthetic polypeptide. In some particular embodiments, the polypeptide is a recombinant polypeptide.

Also provided in the present invention are allelic variants, orthologs, and/or species homologs. Procedures known in the art can be used to obtain full-length genes, allelic variants, splice variants, full-length coding portions, orthologs, and/or species homologs of genes corresponding to any of SEQ ID NOs: 1-218, or SEQ ID NOs: 437-441 using information from the sequences disclosed herein or the clones deposited with the ATCC. For example, allelic variants and/or species homologs may be isolated and identified by making suitable probes or primers from the sequences provided herein and screening a suitable nucleic acid source for allelic variants and/or the desired homologue.

Combinations of Saccharolytic Enzymes

In some embodiments of the present invention, the host cell expresses a combination of heterologous saccharolytic enzymes. For example, the host cell can contain at least two heterologous saccharolytic enzymes, at least three heterologous saccharolytic enzymes, at least four heterologous saccharolytic enzymes, at least five heterologous saccharolytic enzymes, at least six heterologous saccharolytic enzymes, at least seven heterologous saccharolytic enzymes, at least eight heterologous saccharolytic enzymes, at least nine heterologous saccharolytic enzymes, at least ten heterologous saccharolytic enzymes, at least eleven heterologous saccharolytic enzymes, at least twelve heterologous saccharolytic enzymes, at least thirteen heterologous saccharolytic enzymes, at least fourteen heterologous saccharolytic enzymes, or at least fifteen heterologous saccharolytic enzymes. The heterologous saccharolytic enzymes in the host cell can be from the same or from different species. In one embodiment the host cell expresses heterologous enzymes comprising cellobiohydrolases, endo-gluconases, beta-glucosidases, xylanases, xylosidases, glucoamylases, alpha-amylases, alpha-glucosidases, pullulanases, isopullulanases, pectinases, and acetylxylan esterases.

Tethered and Secreted Saccharolytic Enzymes

According to the present invention, the saccharolytic enzymes can be either tethered or secreted. As used herein, a protein is "tethered" to an organism's cell surface if at least one terminus of the protein is bound, covalently and/or electrostatically for example, to the cell membrane or cell wall. It will be appreciated that a tethered protein can include one or more enzymatic regions that can be joined to one or more other types of regions at the nucleic acid and/or protein levels (e.g., a promoter, a terminator, an anchoring domain, a linker, a signaling region, etc.). While the one or more enzymatic regions may not be directly bound to the cell membrane or cell wall (e.g., such as when binding occurs via an anchoring domain), the protein is nonetheless considered a "tethered enzyme" according to the present specification.

Tethering can, for example, be accomplished by incorporation of an anchoring domain into a recombinant protein that is heterologously expressed by a cell, or by prenylation, fatty acyl linkage, glycosyl phosphatidyl inositol anchors or other suitable molecular anchors which may anchor the tethered protein to the cell membrane or cell wall of the host cell. A tethered protein can be tethered at its amino terminal end or optionally at its carboxy terminal end.

As used herein, "secreted" means released into the extra-cellular milieu, for example into the media. Although tethered proteins may have secretion signals as part of their immature amino acid sequence, they are maintained as attached to the cell surface, and do not fall within the scope of secreted proteins as used herein.

As used herein, "flexible linker sequence" refers to an amino acid sequence which links two amino acid sequences, for example, a cell wall anchoring amino acid sequence with an amino acid sequence that contains the desired enzymatic activity. The flexible linker sequence allows for necessary freedom for the amino acid sequence that contains the desired enzymatic activity to have reduced steric hindrance with respect to proximity to the cell and may also facilitate proper folding of the amino acid sequence that contains the desired enzymatic activity.

In some embodiments of the present invention, the tethered cellulase enzymes are tethered by a flexible linker sequence linked to an anchoring domain. In some embodiments, the anchoring domain is of CWP2 (for carboxy terminal anchoring) or FLO1 (for amino terminal anchoring) from *S. cerevisiae*.

In some embodiments, heterologous secretion signals may be added to the expression vectors of the present invention to facilitate the extra-cellular expression of cellulase proteins. In some embodiments, the heterologous secretion signal is the secretion signal from *T. reesei* Xyn2. In other embodiments, the heterologous secretion signal is the *S. cerevisiae* Invertase signal. In yet other embodiments, the heterologous secretion signal is the *S. cerevisiae* AF mating signal.

Fusion Proteins Comprising Saccharolytic Enzymes

The present invention also encompasses fusion proteins. For example, the fusion proteins can be a fusion of a heterologous saccharolytic enzyme and a second peptide. The heterologous saccharolytic enzyme and the second peptide can be fused directly or indirectly, for example, through a linker sequence. The fusion protein can comprise for example, a second peptide that is N-terminal to the heterologous saccharolytic enzyme and/or a second peptide that is C-terminal to the heterologous saccharolytic enzyme. Thus, in certain embodiments, the polypeptide of the present invention comprises a first polypeptide and a second polypeptide, wherein the first polypeptide comprises a heterologous saccharolytic enzyme.

According to one aspect of the present invention, the fusion protein can comprise a first and second polypeptide wherein the first polypeptide comprises a heterologous saccharolytic enzyme and the second polypeptide comprises a signal sequence. According to another embodiment, the fusion protein can comprise a first and second polypeptide, wherein the first polypeptide comprises a heterologous saccharolytic enzyme and the second polypeptide comprises a polypeptide used to facilitate purification or identification or a reporter peptide. The polypeptide used to facilitate purification or identification or the reporter peptide can be, for example, a HIS-tag, a GST-tag, an HA-tag, a FLAG-tag, a MYC-tag, or a fluorescent protein.

According to yet another embodiment, the fusion protein can comprise a first and second polypeptide, wherein the first polypeptide comprises a heterologous saccharolytic enzyme and the second polypeptide comprises an anchoring peptide. In some embodiments, the anchoring domain is of CWP2 (for carboxy terminal anchoring) or FLO1 (for amino terminal anchoring) from *S. cerevisiae*.

According to yet another embodiment, the fusion protein can comprise a first and second polypeptide, wherein the first polypeptide comprises a heterologous saccharolytic enzyme and the second polypeptide comprises a cellulose binding module (CBM or SBM). In some embodiments, the CBM is from, for example, *T. reesei* Cbh1 or Cbh2 or from *C. lucknowense* Cbh2b. In some particular embodiments, the CBM is fused to a endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

In certain embodiments, the polypeptide of the present invention encompasses a fusion protein comprising a first polypeptide and a second polypeptide, wherein the first polypeptide is an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase, and the second polypeptide is selected from a polypeptide encoded by a domain or fragment of a saccharolytic enzyme disclosed herein. In certain embodiments, the polypeptides of the present invention encompasses a fusion protein comprising a first saccharolytic enzyme polypeptide, where the first polypeptide is a domain, derivative or fragment of any saccharolytic enzyme polypeptide disclosed herein, and a second polypeptide, where the second polypeptide is a T. emersonii Cbh1, H. grisea Cbh1, or T. aurantiacusi Cbh1. T. emersonii Cbh2, T. reesei Cbh1 or T. reesei Cbh2, C. lucknowense Cbh2b, or domain, fragment, variant, or derivative thereof. In additional embodiments, the first polypeptide is either N-terminal or C-terminal to the second polypeptide. In certain other embodiments, the first polypeptide and/or the second polypeptide are encoded by codon-optimized polynucleotides, for example, polynucleotides codon-optimized for S. cerevisiae or Kluveromyces.

In certain other embodiments, the first polypeptide and the second polypeptide are fused via a linker sequence. The linker sequence can, in some embodiments, be encoded by a codon-optimized polynucleotide. (Codon-optimized polynucleotides are described in more detail below.) An amino acid sequence corresponding to a codon-optimized linker 1 according to the invention is a flexible linker-strep tag-TEV site-FLAG-flexible linker fusion and corresponds to GGGGSGGGGS AWHPQFGG ENLYFQG DYKDDDK GGGGSGGGGS An exemplary DNA sequence is as follows: GGAGGAG-GTGGTTCAGGAGGTGGTGGGTCTGCTTG-GCATCCACAATTTGGAG GAGGCGGTGGT-GAAAATCTGTATTTCCAGGGAGGCGGAGGTGATT ACAAGGA TGACGACAAGGAGGTGGTGGATCAG-GAGGTGGTGGCTCC (SEQ ID NO:41)

An amino acid sequence corresponding to optimized linker 2 is a flexible linker-strep tag-linker-TEV site-flexible linker and corresponds to GGGGSGGGGS WSHPQFEK GG ENLYFQG GGGGSGGGGS. The DNA sequence is as follows: ggtggcggtggatctggaggaggcggt-tcttggtcacccacaatttgaaaagggtggagaaaacttgtactttcaaggcggtg gtggaggttctggcggaggtggctccggctca.

Co-Cultures

In another aspect, the present invention is directed to co-cultures comprising at least two yeast host cells wherein the at least two yeast host cells each comprise an isolated polynucleotide encoding a saccharolytic enzyme. As used herein. "co-culture" refers to growing two different strains or species of host cells together in the same vessel. In some embodiments of the invention, at least one host cell of the co-culture comprises a heterologous polynucleotide comprising a nucleic acid which encodes an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, alpha-glucosidase, pullulanase, isopullulanase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase at least one host cell of the co-culture comprises a heterologous polynucleotide comprising a nucleic acid which encodes a different endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, alpha-glucosidase, beta-glucosidase, pullulanase, isopullulanase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase and at least one host cell comprises a heterologous polynucleotide comprising a nucleic acid which encodes a still different endoglucanase, glucosidase, cellobiohydrolase, xylanase, glucanase, xylosidase, xylan esterase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, alpha-glucosidase, beta-glucosidase, pullulanase, isopullulanase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

The co-culture can comprise two or more strains of yeast host cells and the heterologous saccharolytic enzymes can be expressed in any combination in the two or more strains of host cells. For example, according to the present invention, the co-culture can comprise two strains: one strain of host cells that expresses an endoglucanase and a second strain of host cells that expresses a β-glucosidase, a cellobiohydrolase and a second cellobiohydrolase. Similarly, the co-culture can comprise one strain of host cells that expresses two saccharolytic enzymes, for example an endoglucanase and a beta-glucosidase and a second strain of host cells that expresses one or more saccharolytic enzymes, for example one or more endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase. The co-culture can, in addition to the at least two host cells comprising heterologous saccharolytic enzymes, also include other host cells which do not comprise heterologous saccharolytic enzymes. The co-culture can comprise one strain expressing an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase; and a second host cell expressing an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

The various host cell strains in the co-culture can be present in equal numbers, or one strain or species of host cell can significantly outnumber another second strain or species of host cells. For example, in a co-culture comprising two strains or species of host cells the ratio of one host cell to another can be about 1:1, 1:2, 1:3, 1:4, 1:5, 1:10, 1:100, 1:500 or 1:1000. Similarly, in a co-culture comprising three or more strains or species of host cells, the strains or species of host cells may be present in equal or unequal numbers.

Biomass feedstocks contain varying proportions of starch, lignocellulose, and pentose sugars. Therefore, in one aspect, yeast strains express different saccharolytic enzymes at different levels. In one embodiment, the one or more amylolytic enzymes are expressed at higher levels in yeast strain(s) as compared to one or more lignocellulases and/or the one or more pentose sugar utilizing enzymes. In another embodiment, the one or more lignocellulases are expressed at higher levels in yeast strain(s) as compared to one or more amylolytic enzymes and/or the one or more pentose sugar utilizing enzymes. In yet another embodiment, the one or more pentose sugar utilizing enzymes are expressed at higher levels in yeast strain(s) as compared to one or more lignocellulases and/or the one or more amylolytic enzymes. In still another embodiment, the one or more amylolytic enzymes, one or more cellulases, and one or more pentose sugar utilizing enzymes are all expressed at approximately equal levels in the yeast strain(s). In some embodiments of the present invention, the ratio of expression of amylolytic enzymes to cellulolytic enzymes in the yeast strain(s) is about 1:5, about 1:2, about 1:1, about 2:1, or about 5:1. In some embodiments of the present invention, the relative expression levels of the amylolytic enzymes and cellulolytic enzymes can be determined using chromatographic techniques, such as HPLC, ion-exchange chromatography, size exclusion chromatography, or by 2D gel electrophoresis, immunoblotting, mass spectrometry, MALDI_TOF, or functional assays.

The co-cultures of the present invention can include tethered saccharolytic enzymes, secreted saccharolytic enzymes or both tethered and secreted saccharolytic enzymes. For example, in some embodiments of the invention, the co-culture comprises at least one yeast host cell comprising a polynucleotide encoding a secreted heterologous saccharolytic enzymes. In another embodiment, the co-culture comprises at least one yeast host cell comprising a polynucleotide encoding a tethered heterologous saccharolytic enzymes. In one embodiment, all of the heterologous saccharolytic enzymes in the co-culture are secreted, and in another embodiment, all of the heterologous saccharolytic enzymes in the co-culture are tethered. In addition, other saccharolytic enzymes, such as externally added saccharolytic enzymes may be present in the co-culture.

Polynucleotides Encoding Heterologous Saccharolytic Enzymes

In another aspect, the present invention includes isolated polynucleotides encoding saccharolytic enzymes of the present invention. Thus, the polynucleotides of the invention can encode endoglucanases, exoglucanases, amylases, or pentose sugar utilizing enzymes. The polynucleotides can encode an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

The present invention also encompasses an isolated polynucleotide comprising a nucleic acid that is at least about 70%, 75%, or 80% identical, at least about 90% to about 95% identical, or at least about 96%, 97%, 98%, 99% or 100% identical to a nucleic acid encoding an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase disclosed herein.

The present invention also encompasses variants of the saccharolytic enzymes genes, as described above. Variants may contain alterations in the coding regions, non-coding regions, or both. Examples are polynucleotide variants containing alterations which produce silent substitutions, additions, or deletions, but do not alter the properties or activities of the encoded polypeptide. In certain embodiments, nucleotide variants are produced by silent substitutions due to the degeneracy of the genetic code. In further embodiments, endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polynucleotide variants can be produced for a variety of reasons, e.g., to optimize codon expression for a particular host. Codon-optimized polynucleotides of the present invention are discussed further below.

The present invention also encompasses an isolated polynucleotide encoding a fusion protein. In certain embodiments, the nucleic acid encoding a fusion protein comprises a first polynucleotide encoding for a endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase as disclosed herein and a CBD (as described above).

In further embodiments, the first and second polynucleotides are in the same orientation, or the second polynucleotide is in the reverse orientation of the first polynucleotide. In additional embodiments, the first polynucleotide encodes a polypeptide that is either N-terminal or C-terminal to the polypeptide encoded by the second polynucleotide. In certain other embodiments, the first polynucleotide and/or the second polynucleotide are encoded by codon-optimized polynucleotides, for example, polynucleotides codon-optimized for *S. cerevisiae, Kluyveromyces* or for both *S. cerevisiae* and *Kluyveromyces*.

Also provided in the present invention are allelic variants, orthologs, and/or species homologs. Procedures known in the art can be used to obtain full-length genes, allelic variants, splice variants, full-length coding portions, orthologs, and/or species homologs of genes corresponding to any of SEQ ID NOs: 1-218, or any of SEQ ID NOs: 437-441, using information from the sequences disclosed herein or the clones deposited with the ATCC or otherwise publically available. For example, allelic variants and/or species homologs may be isolated and identified by making suitable probes or primers from the sequences provided herein and screening a suitable nucleic acid source for allelic variants and/or the desired homologue.

By a nucleic acid having a nucleotide sequence at least, for example 95% "identical" to a reference nucleotide sequence of the present invention, it is intended that the nucleotide sequence of the nucleic acid is identical to the reference sequence except that the nucleotide sequence may include up to five point mutations per each 100 nucleotides of the reference nucleotide sequence encoding the particular polypeptide. In other words, to obtain a nucleic acid having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. The query sequence may be an entire sequence shown of any of SEQ ID NOs: 1-218, or any of SEQ ID NOs: 437-441, or any fragment or domain specified as described herein.

As a practical matter, whether any particular nucleic acid molecule or polypeptide is at least 80%, 85%, 90%, 95%, 96%, 97%, 98% or 99% identical to a nucleotide sequence or polypeptide of the present invention can be determined conventionally using known computer programs. A method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. (1990) 6:237-245.) In a sequence alignment the query and subject sequences are both DNA sequences. An RNA sequence can be compared by converting U's to T's. The result of said global sequence alignment is in percent identity. Preferred parameters used in a FASTDB alignment of DNA sequences to calculate percent identity are: Matrix=Unitary, k-tuple=4, Mismatch Penalty=1, Joining Penalty=30, Randomization Group Length=0, Cutoff Score=1, Gap Penalty=5, Gap Size Penalty 0.05, Window Size=500 or the length of the subject nucleotide sequence, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/alignment of the first 10 bases at 5' end. The 10 unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case the percent identity calculated by FASTDB is not manually corrected. Once again, only bases 5' and 3' of the subject sequence which are not matched/aligned with the query sequence are manually corrected for. No other manual corrections are to be made for the purposes of the present invention.

Some embodiments of the invention encompass a nucleic acid molecule comprising at least 10, 20, 30, 35, 40, 50, 60, 70, 80, 90, 100, 200, 300, 400, 500, 600, 700, or 800 consecutive nucleotides or more of any of SEQ ID NOs: 1-218, or any of SEQ ID NOs: 437-441, or domains, fragments, variants, or derivatives thereof.

The polynucleotide of the present invention may be in the form of RNA or in the form of DNA, which DNA includes cDNA, genomic DNA, and synthetic DNA. The DNA may be double stranded or single-stranded, and if single stranded can be the coding strand or non-coding (anti-sense) strand. The coding sequence which encodes the mature polypeptide can be identical to the coding sequence encoding SEQ ID NO: 219-436, or SEQ ID NO: 442-446, or may be a different coding sequence which coding sequence, as a result of the redundancy or degeneracy of the genetic code, encodes the same mature polypeptide as the nucleic acid sequences of any one of SEQ ID NOs: 1-218, or any one of SEQ ID NOs: 437-441.

In certain embodiments, the present invention provides an isolated polynucleotide comprising a nucleic acid fragment which encodes at least 10, at least 20, at least 30, at least 40, at least 50, at least 60, at least 70, at least 80, at least 90, at least 95, or at least 100 or more contiguous amino acids of SEQ ID NOs: 219-436, or SEQ ID NO: 442-446.

The polynucleotide encoding for the mature polypeptide of SEQ ID NOs: 219-436, or SEQ ID NO: 442-446 may include: only the coding sequence for the mature polypeptide; the coding sequence of any domain of the mature polypeptide: and the coding sequence for the mature polypeptide (or domain-encoding sequence) together with non coding sequence, such as introns or non-coding sequence 5' and/or 3' of the coding sequence for the mature polypeptide.

Thus, the term "polynucleotide encoding a polypeptide" encompasses a polynucleotide which includes only sequences encoding for the polypeptide as well as a polynucleotide which includes additional coding and/or non-coding sequences.

In further aspects of the invention, nucleic acid molecules having sequences at least about 90%, 95%, 96%, 97%, 98% or 99% identical to the nucleic acid sequences disclosed herein, encode a polypeptide having an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase, functional activity.

Of course, due to the degeneracy of the genetic code, one of ordinary skill in the art will immediately recognize that a large portion of the nucleic acid molecules having a sequence at least 90%, 95%, 96%, 97%, 98%, or 99% identical to the nucleic acid sequence of any of SEQ ID NOs: 1-218, or any of SEQ ID NOs: 437-441, or fragments thereof, will encode polypeptides having functional activity. In fact, since degenerate variants of any of these nucleotide sequences all encode the same polypeptide, in many instances, this will be clear to the skilled artisan even without performing the above described comparison assay. It will be further recognized in the art that, for such nucleic acid molecules that are not degenerate variants, a reasonable number will also encode a polypeptide having functional activity.

The polynucleotides of the present invention also comprise nucleic acids encoding an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase, or domain, fragment, variant, or derivative thereof, fused to a polynucleotide encoding a marker sequence which allows for detection of the polynucleotide of the present invention. In one embodiment of the invention, expression of the marker is independent from expression of the saccharolytic enzyme. The marker sequence may be a yeast selectable marker selected from the group consisting of URA3, HIS3, LEU2, TRP1, LYS2, ADE2 or any other suitable selectable marker known in the art. Casey, G. P. et al., "A convenient dominant selection marker for gene transfer in industrial strains of *Saccharomyces* yeast: SMR1 encoded resistance to the herbicide sulfometuron methyl," *J. Inst. Brew.* 94:93-97 (1988).

Codon Optimized Polynucleotides

According to one embodiment of the invention, the polynucleotides encoding heterologous saccharolytic enzymes can be codon-optimized. As used herein the term "codon-optimized coding region" means a nucleic acid coding region that has been adapted for expression in the cells of a given organism by replacing at least one, or more than one, or a significant number, of codons with one or more codons that are more frequently used in the genes of that organism.

In general, highly expressed genes in an organism are biased towards codons that are recognized by the most abundant tRNA species in that organism. One measure of this bias is the "codon adaptation index" or "CAI," which measures the extent to which the codons used to encode each amino acid in a particular gene are those which occur most frequently in a reference set of highly expressed genes from an organism.

The CAI of codon optimized sequences of the present invention corresponds to between about 0.8 and 1.0, between about 0.8 and 0.9, or about 1.0. A codon optimized sequence may be further modified for expression in a particular organism, depending on that organism's biological constraints. For example, large runs of "As" or "Ts" (e.g., runs greater than 4, 5, 6, 7, 8, 9, or 10 consecutive bases) can be removed from the sequences if these are known to effect transcription negatively. Furthermore, specific restriction enzyme sites may be removed for molecular cloning purposes. Examples of such restriction enzyme sites include PacI, AscI, BamHI, BglII, EcoRI and XhoI. Additionally, the DNA sequence can be checked for direct repeats, inverted repeats and mirror repeats with lengths of ten bases or longer, which can be modified manually by replacing codons with "second best" codons, i.e., codons that occur at the second highest frequency within the particular organism for which the sequence is being optimized.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

| | T | C | A | G |
|---|---|---|---|---|
| T | TTT Phe (F) | TCT Ser (S) | TAT Tyr (Y) | TGT Cys (C) |
| | TTC Phe (F) | TCC Ser (S) | TAC Tyr (Y) | TGC |
| | TTA Leu (L) | TCA Ser (S) | TAA Ter | TGA Ter |
| | TTG Leu (L) | TCG Ser (S) | TAG Ter | TGG Trp (W) |
| C | CTT Leu (L) | CCT Pro (P) | CAT His (H) | CGT Arg (R) |
| | CTC Leu (L) | CCC Pro (P) | CAC His (H) | CGC Arg (R) |
| | CTA Leu (L) | CCA Pro (P) | CAA Gln (Q) | CGA Arg (R) |
| | CTG Leu (L) | CCG Pro (P) | CAG Gln (Q) | CGG Arg (R) |
| A | ATT Ile (I) | ACT Thr (T) | AAT Asn (N) | AGT Ser (S) |
| | ATC Ile (I) | ACC Thr (T) | AAC Asn (N) | AGC Ser (S) |
| | ATA Ile (I) | ACA Thr (T) | AAA Lys (K) | AGA Arg (R) |
| | ATG Met (M) | ACG Thr (T) | AAG Lys (K) | AGG Arg (R) |
| G | GTT Val (V) | GCT Ala (A) | GAT Asp (D) | GGT Gly (G) |
| | GTC Val (V) | GCC Ala (A) | GAC Asp (D) | GGC Gly (G) |
| | GTA Val (V) | GCA Ala (A) | GAA Glu (E) | GGA Gly (G) |
| | GTG Val (V) | GCG Ala (A) | GAG Glu (E) | GGG Gly (G) |

Many organisms display a bias for use of particular codons to code for insertion of a particular amino acid in a growing peptide chain. Codon preference or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage Tables are readily available, for example, at http://phenotype.biosci.umbc.edu/codon/sgd/index.php (visited May 7, 2008) or at http://www.kazusa.or.jp/codon/ (visited Mar. 20, 2008), and these tables can be adapted in a number of ways. See Nakamura, Y., et al., "Codon usage tabulated from the international DNA sequence databases: status for the year 2000," *Nucl. Acids Res.* 28:292 (2000). Codon usage tables for yeast, calculated from GenBank Release 128.0 [15 Feb. 2002], are reproduced below as Table 2. This Table uses mRNA nomenclature, and so instead of thymine (T) which is found in DNA, the tables use uracil (U) which is found in RNA. The Table has been adapted so that frequencies are calculated for each amino acid, rather than for all 64 codons.

TABLE 2

Codon Usage Table for *Saccharomyces cerevisiae* Genes

| Amino Acid | Codon | Number | Frequency per hundred |
|---|---|---|---|
| Phe | UUU | 170666 | 26.1 |
| Phe | UUC | 120510 | 18.4 |
| Total | | | |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Total | | | |
| Ile | AUU | 196893 | 30.1 |
| Ile | AUC | 112176 | 17.2 |
| Ile | AUA | 116254 | 17.8 |
| Total | | | |
| Met | AUG | 136805 | 20.9 |
| Total | | | |
| Val | GUU | 144243 | 22.1 |
| Val | GUC | 76947 | 11.8 |
| Val | GUA | 76927 | 11.8 |
| Val | GUG | 70337 | 110.8 |
| Total | | | |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Total | | | |
| Pro | CCU | 88263 | 13.5 |
| Pro | CCC | 44309 | 6.8 |
| Pro | CCA | 119641 | 18.3 |
| Pro | CCG | 34597 | 5.3 |
| Total | | | |
| Thr | ACU | 132522 | 20.3 |
| Thr | ACC | 83207 | 12.7 |
| Thr | ACA | 116084 | 17.8 |
| Thr | ACG | 52045 | 8.0 |
| Total | | | |
| Ala | GCU | 138358 | 21.2 |
| Ala | GCC | 82357 | 12.6 |
| Ala | GCA | 105910 | 16.2 |
| Ala | GCG | 40358 | 6.2 |
| Total | | | |
| Tyr | UAU | 122728 | 18.8 |
| Tyr | UAC | 96596 | 14.8 |
| Total | | | |
| His | CAU | 89007 | 13.6 |
| His | CAC | 50785 | 7.8 |
| Total | | | |
| Gln | CAA | 178251 | 27.3 |
| Gln | CAG | 79121 | 12.1 |
| Total | | | |
| Asn | AAU | 233124 | 35.7 |
| Asn | AAC | 162199 | 24.8 |
| Total | | | |

TABLE 2-continued

Codon Usage Table for *Saccharomyces cerevisiae* Genes

| Amino Acid | Codon | Number | Frequency per hundred |
|---|---|---|---|
| Lys | AAA | 273618 | 41.9 |
| Lys | AAG | 201361 | 30.8 |
| Total | | | |
| Asp | GAU | 245641 | 37.6 |
| Asp | GAC | 132048 | 20.2 |
| Total | | | |
| Glu | GAA | 297944 | 45.6 |
| Glu | GAG | 125717 | 19.2 |
| Total | | | |
| Cys | UGU | 52903 | 8.1 |
| Cys | UGC | 31095 | 4.8 |
| Total | | | |
| Trp | UGG | 67789 | 10.4 |
| Total | | | |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Total | | | |
| Gly | GGU | 156109 | 23.9 |
| Gly | GGC | 63903 | 9.8 |
| Gly | GGA | 71216 | 10.9 |
| Gly | GGG | 39359 | 6.0 |
| Total | | | |
| Stop | UAA | 6913 | 1.1 |
| Stop | UAG | 3312 | 0.5 |
| Stop | UGA | 4447 | 0.7 |

By utilizing this or similar Tables, one of ordinary skill in the art can apply the frequencies to any given polypeptide sequence, and produce a nucleic acid fragment of a codon-optimized coding region which encodes the polypeptide, but which uses codons optimal for a given species. Codon-optimized coding regions can be designed by various different methods.

In one method, a codon usage Table is used to find the single most frequent codon used for any given amino acid, and that codon is used each time that particular amino acid appears in the polypeptide sequence. For example, referring to Table 2 above, for leucine, the most frequent codon is UUG, which is used 27.2% of the time. Thus all the leucine residues in a given amino acid sequence would be assigned the codon UUG.

In another method, the actual frequencies of the codons are distributed randomly throughout the coding sequence. Thus, using this method for optimization, if a hypothetical polypeptide sequence had 100 leucine residues, referring to Table 2 for frequency of usage in the S. cerevisiae, about 5, or 5% of the leucine codons would be CUC, about 11, or 11% of the leucine codons would be CUG, about 12, or 12% of the leucine codons would be CUU, about 13, or 13% of the leucine codons would be CUA, about 26, or 26% of the leucine codons would be UUA, and about 27, or 27% of the leucine codons would be UUG.

These frequencies would be distributed randomly throughout the leucine codons in the coding region encoding the hypothetical polypeptide. As will be understood by those of ordinary skill in the art, the distribution of codons in the sequence can vary significantly using this method: however, the sequence always encodes the same polypeptide.

When using the methods above, the term "about" is used precisely to account for fractional percentages of codon frequencies for a given amino acid. As used herein, "about" is defined as one amino acid more or one amino acid less than the value given. The whole number value of amino acids is rounded up if the fractional frequency of usage is 0.50 or greater, and is rounded down if the fractional frequency of use is 0.49 or less. Using again the example of the frequency of usage of leucine in human genes for a hypothetical polypeptide having 62 leucine residues, the fractional frequency of codon usage would be calculated by multiplying 62 by the frequencies for the various codons. Thus, 7.28 percent of 62 equals 4.51 UUA codons, or "about 5," i.e., 4, 5, or 6 UUA codons, 12.66 percent of 62 equals 7.85 UUG codons or "about 8," i.e., 7, 8, or 9 UUG codons, 12.87 percent of 62 equals 7.98 CUU codons, or "about 8," i.e., 7, 8, or 9 CUU codons, 19.56 percent of 62 equals 12.13 CUC codons or "about 12," i.e., 11, 12, or 13 CUC codons, 7.00 percent of 62 equals 4.34 CUA codons or "about 4," i.e., 3, 4, or 5 CUA codons, and 40.62 percent of 62 equals 25.19 CUG codons, or "about 25," i.e., 24, 25, or 26 CUG codons.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNTI Suite, available from InforMax, Inc., Bethesda, Md., and the "backtranslate" function in the GCG—Wisconsin Package, available from Accelrys, Inc., San Diego. Calif. In addition, various resources are publicly available to codon-optimize coding region sequences, e.g., the "backtranslation" function at http://www.entelechon.com/2008/10/backtranslation-tool/ (visited May 30, 2010). Constructing a rudimentary algorithm to assign codons based on a given frequency can also easily be accomplished with basic mathematical functions by one of ordinary skill in the art.

A number of options are available for synthesizing codon optimized coding regions designed by any of the methods described above, using standard and routine molecular biological manipulations well known to those of ordinary skill in the art. In one approach, a series of complementary oligonucleotide pairs of 80-90 nucleotides each in length and spanning the length of the desired sequence is synthesized by standard methods. These oligonucleotide pairs are synthesized such that upon annealing, they form double stranded fragments of 80-90 base pairs, containing cohesive ends, e.g., each oligonucleotide in the pair is synthesized to extend 3, 4, 5, 6, 7, 8, 9, 10, or more bases beyond the region that is complementary to the other oligonucleotide in the pair. The single-stranded ends of each pair of oligonucleotides is designed to anneal with the single-stranded end of another pair of oligonucleotides. The oligonucleotide pairs are allowed to anneal, and approximately five to six of these double-stranded fragments are then allowed to anneal together via the cohesive single stranded ends, and then they ligated together and cloned into a standard bacterial cloning vector, for example, a TOPO® vector available from Invitrogen Corporation, Carlsbad. Calif. The construct is then sequenced by standard methods. Several of these constructs consisting of 5 to 6 fragments of 80 to 90 base pair fragments ligated together. i.e., fragments of about 500 base pairs, are prepared, such that the entire desired sequence is represented in a series of plasmid constructs. The inserts of these plasmids are then cut with appropriate restriction enzymes and ligated together to form the final construct. The final construct is then cloned into a standard bacterial cloning vector, and sequenced. Additional methods would be immediately apparent to the skilled artisan. In addition, gene synthesis is readily available commercially.

In certain embodiments, an entire polypeptide sequence, or fragment, variant, or derivative thereof is codon optimized by any of the methods described herein. Various desired fragments, variants or derivatives are designed, and each is then codon-optimized individually. In addition, partially codon-optimized coding regions of the present invention can be designed and constructed. For example, the invention includes a nucleic acid fragment of a codon-optimized coding region encoding a polypeptide in which at least about 1%, 2%, 3%, 4%, 5%, 10%, 15%, 20%, 25%, 30%, 35%, 40%, 45%, 50%, 55%, 60%, 65%, 70%, 75%, 80%, 85%, 90%, 95%, or 100% of the codon positions have been codon-optimized for a given species. That is, they contain a codon that is preferentially used in the genes of a desired species, e.g., a yeast species such as Saccharomyces cerevisiae or Kluveromyces, in place of a codon that is normally used in the native nucleic acid sequence.

In additional embodiments, a full-length polypeptide sequence is codon-optimized for a given species resulting in a codon-optimized coding region encoding the entire polypeptide, and then nucleic acid fragments of the codon-optimized coding region, which encode fragments, variants, and derivatives of the polypeptide are made from the original codon-optimized coding region. As would be well understood by those of ordinary skill in the art, if codons have been randomly assigned to the full-length coding region based on their frequency of use in a given species, nucleic acid fragments encoding fragments, variants, and derivatives would not necessarily be fully codon optimized for the given species. However, such sequences are still much closer to the codon usage of the desired species than the native codon usage. The advantage of this approach is that synthesizing codon-optimized nucleic acid fragments encoding each fragment, variant, and derivative of a given polypeptide, although routine, would be time consuming and would result in significant expense.

The codon-optimized coding regions can be, for example, versions encoding an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase as disclosed herein, or domains, fragments, variants, or derivatives thereof.

Codon optimization is carried out for a particular species by methods described herein, for example, in certain embodiments codon-optimized coding regions encoding polypeptides disclosed in the present application or domains, fragments, variants, or derivatives thereof are optimized according to yeast codon usage, e.g., Saccharomyces cerevisiae, Kluyveromyces lactis and/or Kluyveromyces marxianus. Also provided are polynucleotides, vectors, and other expression constructs comprising codon-optimized coding regions encoding polypeptides disclosed herein, or domains, fragments, variants, or derivatives thereof, and various methods of using such polynucleotides, vectors and other expression constructs.

In certain embodiments described herein, a codon-optimized coding region encoding any of SEQ ID NOs: 219-436, or any of SEQ ID NOs: 442-446, or domain, fragment, variant, or derivative thereof, is optimized according to codon usage in yeast (e.g. Saccharomyces cerevisiae, Kluyveromyces lactis or Kluyveromyces marxianus). In some embodiments, the sequences are codon-optimized specifically for expression in Saccharomyces cerevisiae. Alternatively, a codon-optimized coding region encoding any of SEQ ID NOs: 219-436, or any of SEQ ID NOs: 442-446 may be optimized according to codon usage in any plant, animal, or microbial species.

Vectors and Methods of Using Vectors in Host Cells

In another aspect, the present invention relates to vectors which include polynucleotides of the present invention, host cells which are genetically engineered with vectors of the invention and the production of polypeptides of the invention by recombinant techniques.

Host cells are genetically engineered (transduced or transformed or transfected) with the vectors of this invention which may be, for example, a cloning vector or an expression vector. The vector may be, for example, in the form of a plasmid, a viral particle, a phage, etc. The engineered host cells can be cultured in conventional nutrient media modified as appropriate for activating promoters, selecting transformants or amplifying the genes of the present invention. The culture conditions, such as temperature, pH and the like, are those previously used with the host cell selected for expression, and will be apparent to the ordinarily skilled artisan.

The polynucleotides of the present invention can be employed for producing polypeptides by recombinant techniques. Thus, for example, the polynucleotide may be included in any one of a variety of expression vectors for expressing a polypeptide. Such vectors include chromosomal, nonchromosomal and synthetic DNA sequences, e.g., derivatives of SV40; bacterial plasmids; and yeast plasmids. However, any other vector may be used as long as it is replicable and viable in the host.

The appropriate DNA sequence can be inserted into the vector by a variety of procedures. In general, the DNA sequence is inserted into an appropriate restriction endonuclease site(s) by procedures known in the art. Such procedures and others are deemed to be within the scope of those skilled in the art.

The DNA sequence in the expression vector is operatively associated with an appropriate expression control sequence(s) (promoter) to direct mRNA synthesis. Representative examples of such promoters are as follows:

| Gene | Organism | Systematic name | Reason for use/benefits |
|------|----------|-----------------|-------------------------|
| PGK1 | S. cerevisiae | YCR012W | Strong constitutive promoter |
| ENO1 | S. cerevisiae | YGR254W | Strong constitutive promoter |
| TDH3 | S. cerevisiae | YGR192C | Strong constitutive promoter |
| TDH2 | S. cerevisiae | YJR009C | Strong constitutive promoter |
| TDH1 | S. cerevisiae | YJL052W | Strong constitutive promoter |
| ENO2 | S. cerevisiae | YHR174W | Strong constitutive promoter |
| GPM1 | S. cerevisiae | YKL152C | Strong constitutive promoter |
| TPI1 | S. cerevisiae | YDR050C | Strong constitutive promoter |

Additionally, promoter sequences from stress and starvation response genes are useful in the present invention. In some embodiments, promoter regions from the S. cerevisiae genes GAC1, GET3, GLC7, GSH1, GSH2, HSF1, HSP12, LCB5, LRE1, LSP1, NBP2, PDC1, PIL1, PIM1, SGT2, SLG1, WHI2, WSC2, WSC3, WSC4, YAP1, YDC1, HSP104, HSP26, ENA1, MSN2, MSN4, SIP2, SIP4, SIP5, DPL1, IRS4, KOG1, PEP4, HAP4, PRB1, TAX4, ZPR1, ATG1, ATG2, ATG10, ATG11, ATG12, ATG13, ATG14, ATG15, ATG16, ATG7, ATG18, and ATG19 may be used. Any suitable promoter to drive gene expression in the host cells of the invention may be used. Additionally the *E. coli*, lac or trp, and other promoters known to control expression of genes in prokaryotic or lower eukaryotic cells can be used.

In addition, the expression vectors may contain one or more selectable marker genes to provide a phenotypic trait for selection of transformed host cells such as URA3, HIS3, LEU2, TRP1, LYS2 or ADE2, dihydrofolate reductase, neomycin (G418) resistance or zeocin resistance for eukaryotic cell culture, or tetracycline or ampicillin resistance in *E. coli*.

The expression vector may also contain a ribosome binding site for translation initiation and/or a transcription terminator. The vector may also include appropriate sequences for amplifying expression, or may include additional regulatory regions.

The vector containing the appropriate DNA sequence as disclosed herein, as well as an appropriate promoter or control sequence, may be employed to transform an appropriate host to permit the host to express the protein.

Thus, in certain aspects, the present invention relates to host cells containing the above-described constructs. The host cell can be a host cell as described elsewhere in the application. The host cell can be, for example, a lower eukaryotic cell, such as a yeast cell, e.g., *Saccharomyces cerevisiae* or *Kluyveromyces*, or the host cell can be a prokaryotic cell, such as a bacterial cell.

As representative examples of appropriate hosts, there may be mentioned: bacterial cells, such as *E. coli, Streptomyces, Salmonella typhimurium*; thermophilic or mesophlic bacteria; fungal cells, such as yeast: and plant cells, etc. The selection of an appropriate host is deemed to be within the scope of those skilled in the art from the teachings herein.

Appropriate fungal hosts include yeast. In certain aspects of the invention the yeast is selected from the group consisting of *Saccharomyces cerevisiae, Kluyveromyces lactis, Schizzosaccharomyces pombe, Candida albicans, Pichia pastoris, Pichia stipitis, Yarrowia lipolytica, Hansenula polymorpha, Phaffia rhodozyma, Candida utilis, Arxula adeninivorans, Debaryomyces hansenii, Debaryomyces polymorphus, Schwanniomyces occidentalis, Issatchenkia orientalis, Kluyveromyces marxianus, Blakeslea, Candida, Cryptococcus, Cunninghamella, Lipomyces, Mortierella, Mucor, Phycomces, Pythium, Rhodosporidium, Rhodotorula, Trichosporon* and *Yarrowia*.

Methods of Using Host Cells to Produce Ethanol or Other Fermentation Products

In another aspect, the present invention is directed to the use of host cells and co-cultures to produce ethanol or other products from a biomass feedstock comprising starch, lignocellulosic matter, hexose and pentose sugars. Such methods can be accomplished, for example, by contacting a biomass feedstock with a host cell or a co-culture of the present invention. Fermentation products include, but are not limited to products such as butanol, acetate, amino acids, and vitamins.

Numerous biomass feedstocks can be used in accordance with the present invention. Substrates for saccharolytic enzyme activity assays can be divided into two categories, soluble and insoluble, based on their solubility in water. Soluble substrates include alpha-dextrins, cellodextrins or derivatives, carboxymethyl cellulose (CMC), or hydroxyethyl cellulose (HEC). Insoluble substrates include insoluble starch, crystalline cellulose, microcrystalline cellulose (Avicel), amorphous cellulose, such as phosphoric acid swollen cellulose (PASC), dyed or fluorescent cellulose, and lignocellulosic biomass. These substrates are generally highly ordered cellulosic material and thus only sparingly soluble.

It will be appreciated that suitable lignocellulosic material may be any feedstock that contains soluble and/or insoluble cellulose, where the insoluble cellulose may be in a crystalline or non-crystalline form. In various embodiments, the lignocellulosic biomass comprises, for example, wood, corn, corn stover, sawdust, bark, leaves, agricultural and forestry residues, grasses such as switchgrass, ruminant digestion products, municipal wastes, paper mill effluent, newspaper, cardboard or combinations thereof.

In some embodiments, the invention is directed to a method for hydrolyzing a biomass feedstock, for example a biomass feedstock as described above, by contacting the biomass feedstock with a host cell of the invention. In some embodiments, the invention is directed to a method for hydrolyzing a biomass feedstock, for example a biomass feedstock as described above, by contacting the feedstock with a co-culture comprising yeast cells expressing heterologous saccharolytic enzymes.

In some embodiments of the present invention, the necessity of adding external saccharolytic enzymes to the fermentation medium is reduced because cells of the invention express polypeptides of the invention.

In some embodiments, the invention is directed to a method for fermenting a biomass feedstock. Such methods can be accomplished, for example, by culturing a host cell or co-culture in a medium that contains insoluble biomass feedstock to allow saccharification and fermentation of the biomass feedstock.

In addition to the enzymes of the present invention, in some embodiments, host cells of the present invention can have further genetic modifications to make them more suitable for fermenting biomass feedstock to ethanol. For example, host cells of the present invention may express xylose isomerase and/or arabinose isomerase inorder to more efficiently use pentose sugars for fermentation. In some embodiments, the xylose isomerase is from a *Pyromyces* species. In addition to a xylose isomerase, host cells of the invention, in some embodiments, can over-express genes related to the pentose phosphate pathway. These genes include, but are not limited to transkelolase and transaldolase genes. Components of the pentose phosphate pathway are known to those skilled in the art and are useful in aiding assimilation of carbons derived from pentose sugars into fermentation processes. (See, e.g. WO 03/062430, WO 06/009434, and US 2006/0234364). In some embodiments, a host cell is able to use xylose and other pentose sugars such as arabinose by incorporating the carbons from pentose sugars into fermentative pathways via the pentose phosphate pathway. The xylose-utilizing host cell heterologously expresses xylose isomerase, e.g. *Pyromyces* sp. E2 XylA, overexpresses xylulokinase, ribulose 5-phosphate isomerase, ribulose 5-phosphate epimerase, transketolase and transaldolase, and does not express an aldose reductase such as the GRE3 gene (encoding an aldose reductase).

The production of ethanol can, according to the present invention, be performed at temperatures of at least about 25° C., about 28° C., about 30° C., about 31° C., about 32° C., about 33° C., about 34° C. about 35° C., about 36° C., about 37° C., about 38° C., about 39° C., about 40° C. about 41° C. about 42° C., or about 50° C. In some embodiments of the present invention, the thermotolerant host cell can produce ethanol from cellulose at temperatures above about 30° C., about 31° C., about 32° C. about 33° C., about 34° C., about 35° C., about 36° C., about 37° C. about 38° C., about 39° C., about 40° C., about 41° C., about 42° C., or about 50° C. In some embodiments of the present invention, the thermotolterant host cell can produce ethanol from cellulose at temperatures from about 30° C. to 60° C., about 30° C. to 55° C., about 30° C. to 50° C., about 40° C. to 60° C., about 40° C. to 55° C. or about 40° C. to 50° C.

In some embodiments, methods of producing ethanol can comprise contacting a biomass feedstock with a host cell or co-culture of the invention and additionally contacting the biomass feedstock with externally produced saccharolytic enzymes. Exemplary externally produced saccharolytic enzymes are commercially available and are known to those of skill in the art and are further exemplified below.

Therefore, the invention is also directed to methods of reducing the amount of externally produced saccharolytic enzymes required to produce a given amount of ethanol from the biomass feedstock comprising contacting the saccharolytic enzyme with externally produced saccharolytic enzymes and with a host cell or co-culture of the invention. In some embodiments, the same amount of ethanol production can be achieved using at least about 5%, 10%, 15%, 20%, 25%, 30%, or 50% fewer externally produced saccharolytic enzymes.

In some embodiments, the methods comprise producing ethanol at a particular rate. For example, in some embodiments, ethanol is produced at a rate of at least about 0.1 mg per hour per liter, at least about 0.25 mg per hour per liter, at least about 0.5 mg per hour per liter, at least about 0.75 mg per hour per liter, at least about 1.0 mg per hour per liter, at least about 2.0 mg per hour per liter, at least about 5.0 mg per hour per liter, at least about 10 mg per hour per liter, at least about 15 mg per hour per liter, at least about 20.0 mg per hour per liter, at least about 25 mg per hour per liter, at least about 30 mg per hour per liter, at least about 50 mg per hour per liter, at least about 100 mg per hour per liter, at least about 200 mg per hour per liter, or at least about 500 mg per hour per liter.

In some embodiments, the host cells of the present invention can produce ethanol at a rate of at least about 0.1 mg per hour per liter, at least about 0.25 mg per hour per liter, at least about 0.5 mg per hour per liter, at least about 0.75 mg per hour per liter, at least about 1.0 mg per hour per liter, at least about 2.0 mg per hour per liter, at least about 5.0 mg per hour per liter, at least about 10 mg per hour per liter, at least about 15 mg per hour per liter, at least about 20.0 mg per hour per liter, at least about 25 mg per hour per liter, at least about 30 mg per hour per liter, at least about 50 mg per hour per liter, at least about 100 mg per hour per liter, at least about 200 mg per hour per liter, or at least about 500 mg per hour per liter more than a control strain (lacking heterologous biomass feedstock hydrolyzing enzymes) and grown under the same conditions. In some embodiments, the ethanol can be produced in the absence of any externally added saccharolytic enzymes.

Ethanol production can be measured using any method known in the art. For example, the quantity of ethanol in fermentation samples can be assessed using HPLC analysis. Many ethanol assay kits are commercially available that use, for example, alcohol oxidase enzyme based assays. Methods of determining ethanol production are within the scope of those skilled in the art from the teachings herein.

Synergistic Activity of Sacchcarolytic Enzymes

In some embodiments, the expression of two or more enzymes of the present invention results in synergistic enzymatic activity with respect to substrate digestion. For example, the presence of two distinct paralogs or orthologs containing the same enzymatic activity can significantly enhance the digestion of a substrate compared to a comprarable amount of either enzyme by itself. Alternatively, synergistically acting enzymes do not need to have exactly identical chemical activity, but can still operate to liberate sugars in a capacity greater than either is capable of individually. Without wishing to be bound by a particular theory, it is thought that although the catalytic activity of the enzymes can be the same, the different characteristics of the enzymes with respect to the regions surrounding the chemical substrate as well as other differing properties of the enzymes aid in digesting the varied biomass feedstock components. In some embodiments, enzymatic synergy allows biomass feedstock digestion and fermentation to take place using reduced amounts of external saccharolytic enzymes. In some embodiments, the two or more enzymes acting synergistically are endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterases, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase as disclosed herein. In some embodiments, the two or more enzymes acting synergistically do not have the same enzymatic activity. In other embodiments, the two or more enzymes acting synergistically have the same enzyme activity. In some embodiments, the enzyme pairs acting synergistically are (*Streptomyces avermitilis* endo-1,4-beta-glucanase celA2 (Accession No. NP_823030.1) and *Streptomyces avermitilis* endo-1,4-beta-glucanase celA5 (Accession No. NP_828072.1)); (*Streptomyces avermitilis* endo-1,4-beta-glucanase celA2 (Accession No. NP_823030.1) and *Bacillus subtilis* endo-1,4-beta-glucanase (Accession No CAB13696.2)); (*Streptomyces avermitilis* endo-1,4-beta-glucanase celA3 (Accession No. NP_823032.1) and *Streptomyces avermitilis* endo-1,4-beta-glucanase (Accession No. NP_826394.1)); (*Streptomyces avermitilis* endo-1,4-beta-glucanase celA4 (Accession No. NP_823744.1) and *Streptomyces avermitilis* xylanase (Accession No. NP_827548.1)); (*Bacillus subtilis* endo-1,4-beta-glucanase (Accession No CAB13696.2) and *Streptomyces avermitilis* endo-1,4-beta-glucanase (Accession No. NP_826394.1)); (*Streptomyces avermitilis* endo-1,4-beta-glucanase celA4 (Accession No. NP_823744.1) and *Bacillus subtilis* endo-1, 4-beta-glucanase (Accession No CAB13696.2)); (*Streptomyces avermitilis* endo-1,4-beta-glucanase celA5 (Accession No. NP_828072.1) and *Streptomyces avermitilis* endo-1,4-beta-glucanase celA4 (Accession No. NP_823744.1)); (*Streptomyces avermitilis* endo-1,4-beta-glucanase celA5 (Accession No. NP_828072.1) and *Clostridium phytofermentans* xylanase (Accession No. YP_001557750.1)); (*Saccharophagus degradans* 2-40 mannanase (Accession No. YP_525985.1) and *Streptomyces avermitilis* endo-1,4-beta-glucanase (Accession No. NP_826394.1)); (*Streptomyces avermitilis* xylanase (Accession No. NP_827548.1) and *Saccharophagus degradans* 2-40 mannanase (Accession No. YP_525985.1)); (*Clostridium phytofermentans* xylanase (Accession No. YP_001557750.1) and *Streptomyces avermitilis* xylanase (Accession No. NP_827548.1));

(*Clostridium phytofermentans* xylanase (Accession No. YP_001557750.1) and *Streptomyces avermitilis* xylanase (Accession No. NP_827548.1)); (*Streptomyces avermitilis* endo-1,4-beta-glucanase celA5 (Accession No. NP_828072.1) and *Streptomyces avermitilis* xylanase (Accession No. NP_827548.1)); (*Streptomyces avermitilis* endo-1,4-beta-glucanase (Accession No. NP_823744.1) and *Saccharophagus degradans* 2-40 mannanase (Accession No. YP_525985.1)); (*Streptomyces avermitilis* endo-1,4-beta-glucanase celA2 (Accession No. NP_823030.1) and *Saccharophagus degradans* 2-40 mannanase (Accession No. YP_525985.1)); (*Streptomyces avermitilis* endo-1,4-beta-glucanase (Accession No. NP_823744.1) and *Streptomyces avermitilis* endo-1,4-beta-glucanase celA3 (Accession No. NP_823032.1)); (*Streptomyces avermitilis* endo-1,4-beta-glucanase (Accession No. NP_823744.1) and *Clostridium phytofermentans* xylanase (Accession No. YP_001557750.1)); (*Streptomyces avermitilis* xylanase (Accession No. NP_827548.1) and *Streptomyces avermitilis* endo-1,4-beta-glucanase celA3 (Accession No. NP_823032.1)); or (*Streptomyces avermitilis* endo-1,4-beta-glucanase celA4 (Accession No. NP_823744.1) and *Streptomyces avermitilis* endo-1,4-beta-glucanase (Accession No. NP_826394.1)); (SEQ ID NO: 443 and SEQ ID NO: 444); (SEQ ID NO: 443 and SEQ ID NO: 445); (SEQ ID NO: 445 and SEQ ID NO: 446); (SEQ ID NO: 443 and SEQ ID NO: 445); (SEQ ID NO: 442 and SEQ ID NO: 445); (SEQ ID NO: 444 and *Bacillus subtilis* arabinoxylanase (Accession No. CAB13699.1)); (SEQ ID NO: 444 and *Bacillus subtilis* arabinan endo-1,5-alpha-L-arabinosidase (Accession No. CAB15969.1)); (SEQ ID NO: 444 and *Bacillus subtilis* arabinan-endo 1,5-alpha-L-arabinase (Accession No. CAA99586.1)); (SEQ ID NO: 444 and *Bacillus subtilis* arabinan endo-1,5-alpha-L-arabinosidase (Accession No. AL009126)); (SEQ ID NO: 444 and *Bacillus subtilis* endo-arabinase (Accession No. D85132)); (SEQ ID NO: 444 and *Clostridium phytofermentans* arabinogalactan endo-1,4-beta-galactosidase (Accession No. CP000885)); (SEQ ID NO: 444 and *Bacillus licheniformis* arabinan-endo 1,5-alpha-L-arabinase (Accession No. AAU40201.1); (SEQ ID NO: 444 and *Bacillus licheniformis* arabinan-endo 1,5-alpha-L-arabinase (Accession No. AAU41895.1); (SEQ ID NO: 444 and *Bacillus licheniformis* arabinogalactan endo-1,4-beta-galactosidase (Accession No. AAU43089.1); (SEQ ID NO: 444 and *Bacillus licheniformis* arabinan endo-1,5-alpha-L-arabinosidase (Accession No. AAU43033.1); (SEQ ID NO: 444 and *Bacillus licheniformis* arabinan endo-1,4-beta-xylanase (Accession No. AAU39947.1); (SEQ ID NO: 444 and *Thermoanaerobacterium saccharolyticum* arabinogalactan endo-1,4-beta-galactosidase; (SEQ ID NO: 444 and *Thermoanaerobacterium saccharolyticum* alpha-N-arabinofuranosidase); (SEQ ID NO: 444 and *Streptomyces avermitilis* endo-1,4-beta-xylanase xynD (Accession No. 827557.1); (SEQ ID NO: 444 and *Bacillus subtilis* endo-1,4-beta-xylanase xynA (Accession No. CAB13776.1); (SEQ ID NO: 444 and *Clostridium phytofermentans* xylanase (Accession No. YP_001558623.1); (SEQ ID NO: 444 and *Clostridium phytofermentans* xylanase (Accession No. YP_001557750.1); (SEQ ID NO: 444 and *Thermobifida fusca* endo-1,4-beta-D-xylanase (xyl11) (Accession No. AAV64879.1); (SEQ ID NO: 444 and *Clostridium thermocellum* xylanase (Accession No. YP_001038519.1); (SEQ ID NO: 444 and *Clostridium stercorarium* endo-xylanase (Accession No. CAD48307); (SEQ ID NO: 444 and *Clostridium stercorarium* xynC (CelX-celloxylanase) (Accession No. CAD48314); (SEQ ID NO: 444 and *Aspergillus niger* alpha-glucosidase (Accession No. BAA23616.1)); (SEQ ID NO: 444 and *Thermoanaerobacterium saccharolyticum* glucoamylase).

In other embodiments, the enzyme triplets acting synergistically include, but are not limited to (SEQ ID NO: 442, SEQ ID NO: 445 and SEQ ID NO: 446); (SEQ ID NO: 444, SEQ ID NO: 445 and SEQ ID NO: 446); or (SEQ ID NO: 442, SEQ ID NO: 445 and SEQ ID NO: 446).

In yet other embodiments, the enzyme combinations acting synergistically include, but are not limited to (SEQ ID NO: 442, SEQ ID NO: 444, SEQ ID NO: 445 and SEQ ID NO: 446); (SEQ ID NO: 443, SEQ ID NO: 444, SEQ ID NO: 445 and SEQ ID NO: 446).

In other embodiments, enzymatic synergy may be achieved by expressing 3, 4, 5, 6, or 7 or more enzymes with the same catalytic activity. In one embodiment, two or more enzymes acting synergistically with same enzymatic activity include, but are not limited to (SEQ ID NO: 444 and SEQ ID NO: 444); (SEQ ID NO: 445 and SEQ ID NO: 445).

Glycerol Reduction

Anaerobic growth conditions require the production of endogenouse electron acceptors, such as the coenzyme nicotinamide adenine dinucleotide ($NAD^+$). In cellular redox reactions, the $NAD^+$/NADH couple plays a vital role as a reservoir and carrier of reducing equivalents. Ansell, R., et al., *EMBO J.* 16:2179-87 (1997). Cellular glycerol production, which generates an $NAD^+$, serves as a redox valve to remove excess reducing power during anaerobic fermentation in yeast. Glycerol production is, however, an energetically wasteful process that expends ATP and results in the loss of a reduced three-carbon compound. Ansell, R., et al., *EMBO J.* 16:2179-87 (1997). To generate glycerol from a starting glucose molecule, glycerol 3-phosphate dehydrogenase (GPD) reduces dihydroxyacetone phosphate to glycerol 3-phosphate and glycerol 3-phosphatase (GPP) dephosphorylates glycerol 3-phosphate to glycerol. Despite being energetically wasteful, glycerol production is a necessary metabolic process for anaerobic growth as deleting GPD activity completely inhibits growth under anaeroblic conditions. See Ansell, R., et al., *EMBO J.* 16:2179-87 (1997).

GPD is encoded by two isogenes, gpd1 and gpd2. GPD1 encodes the major isoform in anaerobically growing cells, while GPD2 is required for glycerol production in the absence of oxygen, which stimulates its expression. Pahlman. A-K., et al., *J. Biol. Chem.* 276:3555-63 (2001). The first step in the conversion of dihydroxyacetone phosphate to glycerol by GPD is rate controlling. Guo, Z. P., et al., *Metab. Eng.* 13:49-59 (2011). GPP is also encoded by two isogenes, gpp1 and gpp2. The deletion of GPP genes arrests growth when shifted to anaerobic conditions, demonstrating that GPP is important for cellular tolerance to osmotic and anaerobic stress. See Pahlman, A-K., et al., *J. Biol. Chem.* 276:3555-63 (2001).

Because glycerol is a major by-product of anaerobic production of ethanol, many efforts have been made to delete cellular production of glycerol. However, because of the reducing equivalents produced by glycerol synthesis, deletion of the glycerol synthesis pathway cannot be done without compensating for this valuable metabolic function. Attempts to delete glycerol production and engineer alternate electron acceptors have been made. Lidén, G., et al., *Appl. Env. Microbiol.* 62:3894-96 (1996); Medina, V. G., et al., *Appl. Env. Microbiol.* 76:190-195 (2010). Lidén and Medina both deleted the gpd1 and gpd2 genes and attempted to bypass glycerol formation using additional carbon sources. Lidén engineered a xylose reductase from *Pichia stipitis* into an *S. cerevisiae* gpd1/2 deletion strain. The xylose reductase activity facilitated the anaerobic growth of the glycerol-deleted strain in the presence of xylose. See Lidén, G., et al., *Appl. Env. Microbiol.* 62:3894-96 (1996). Medina engineered an acetylaldehyde dehydrogenase, mhpF, from *E. coli* into an *S. cerevisiae* gpd1/2 deletion strain to convert acetyl-CoA to acetaldehyde. The acetylaldehyde dehydrogenase activity facilitated the anaerobic growth of the glycerol-deletion strain in the presence of acetic acid but not in the presence of glucose as the sole source of carbon. Medina, V. G., et al., *Appl. Env. Microbiol.* 76:190-195 (2010); see also EP 2277989. Medina noted several issues with the mhpF-containing strain that needed to be addressed before implementing industrially, including significantly reduced growth and product formation rates than yeast comprising GPD1 and GPD2.

Additional attempts to redirect flux from glycerol to ethanol have included the engineering of a non-phosphorylating NADP+-dependent glyceraldehydes-3-phosphate dehydrogenase (GAPN) into yeast, either with or without the simultaneous knockout of GPD1. Bro, C., et al., *Metab. Eng.* 8:102-111 (2006); U.S. Patent Appl. Pub. No. US2006/0257983; Guo, Z. P., et al., *Metab. Eng.* 13:49-59 (2011). However, other cellular mechanisms exist to control the production and accumulation of glycerol, including glycerol exporters such as FPS1, that do not require the engineering of alternate NADP+/NADPH coupling or deletion of glycerol synthesis genes. Tamás, M. J., et al., *Mol. Microbiol.* 31:1087-1004 (1999).

FPS1 is a channel protein located in the plasma membrane that controls the accumulation and release of glycerol in yeast osmoregulation. Null mutants of this strain accumulate large amounts of intracellular glycerol, grow much slower than wild-type, and consume the sugar substrate at a slower rate. Tamás, M. J., et al., *Mol. Microbiol.* 31:1087-1004 (1999). Despite slower growth under anaerobic conditions, an fps1Δ strain can serve as an alternative to eliminating NAD$^+$-dependant glycerol activity. An fps1Δ strain has reduced glycerol formation yet has a completely functional NAD$^+$-dependant glycerol synthesis pathway. Alternatively, rather than deleting endogenous FPS1, constitutively active mutants of FPS1 or homologs from other organisms can be used to regulate glycerol synthesis while keep the NAD$^+$-dependant glycerol activity intact. In embodiments of the invention that modulate FPS1, the recombinant host cells can still synthesize and retain glycerol and achieve improved robustness relative to strains that are unable to make glycerol.

In one embodiment, one or more endogenous glycerol-producing or regulating genes are deleted to create yeast strains with altered glycerol production. In another embodiment, one or more endogenous glycerol-producing genes are downregulated to create yeast strains with altered glycerol production. In still another embodiment, one or more endogenous glycerol-regulating genes are downregulated to create yeast strains with altered glycerol production. In yet another embodiment, one or more endogenous glycerol-regulating genes are downregulated to create yeast strains with altered glycerol production. In one embodiment, glycerol production in such yeast strains is downregulated in comparison with wild type yeast cell.

Pyruvate Formate Lyase (PFL)

The conversion of the pyruvate to acetyl-CoA and formate is performed by pyruvate formate lyase (PFL). In *E. coli*, PFL is the primary enzyme responsible for the production of formate. PFL is a dimer of PflB that requires the activating enzyme PflAE, which is encoded by pflA, radical S-adenosylmethionine, and a single electron donor. See Waks, Z., and Silver, P. A., *Appl. Env. Microbiol.* 75:1867-1875 (2009). Waks and Silver engineered strains of *S. cerevisiae* to secrete formate by the addition of PFL and AdhE from *E. coli* and deletion of endogenous formate dehydrogenases and to produce hydrogen in a two-step process using *E. coli*. Waks and Silver, however, did not combine formate production with the removal of glycerol formation, and the use of formate as an alternate electron acceptor for the reduction of glycerol was not proposed or evaluated.

PFL enzymes for use in the recombinant host cells of the invention can come from a bacterial or eukaryotic source. Examples of bacterial PFL include, but are not limited to, *Bacillus licheniformis* DSM13, *Bacillus licheniformis* ATCC14580, *Streptococcus thermophilus* CNRZ1066, *Streptococcus thermophilus* LMG18311, *Streptococcus thermophilus* LMD-9. *Lactobacillus plantarum* WCFS1 (Gene Accession No. lp_2598), *Lactobacillus plantarum* WCFS1 (Gene Accession No. lp_3313), *Lactobacillus plantarum* JDM1 (Gene Accession No. JDM1_2695), *Lactobacillus plantarum* JDM1 (Gene Accession No. JDM1_2087), *Lactobacillus casei* b123. *Lactobacillus casei* ATCC 334, *Bifidobacterium adolescentis*, *Bifidobacterium longum* NCC2705, *Bifidobacterium longum* DJO10A, *Bifidobacterium animalis* DSM 10140, *Clostridium cellulolyticum*, or *Escherichia coli*. Additional PFL enzymes may be from the PFL1 family, the RNR pfl superfamily, or the PFL2 superfamily.

Examples of eukaryotic PFL include, but are not limited to, *Chlamydomonas reinhardtii* PflA1, *Piromyces* sp. E2, or *Neocallimastix frontalis*, *Acetabularia acetabulum*, *Haematococcus pluvialis*, *Volvox carteri*, *Ostreococcus tauri*, *Ostreococcus lucimarinus*, *Micromonas pusilla*, *Micromonas* sp., *Porphyra haitanensis*, and *Cyanophora paradoxa*), an opisthokont (*Amoebidium parasiticum*), an amoebozoan (*Mastigamoeba balamuthi*), a stramenopile (*Thalassiosira pseudonana* (2)) and a haptophyte (*Prymnesium parvum*), *M. pusilla*, *Micromonas* sp. *O. tauri* and *O. lucimarinus*) an amoebozoan (*M. balamuthi*), and a stramenopile (*T. pseudonana*). See Stairs, C. W., et al., "Eukaryotic pyruvate formate lyase and its activating enzyme were acquired laterally from a firmicute," Mol. Biol. and Evol., published on-line on Feb. 3, 2011, at http://mbe.oxfordjournals.org/.

Acetaldehyde/Alcohol Dehydrogenases

Engineering of acetaldehyde dehydrogenases, alcohol dehydrogenases, and/or bifunctional acetylaldehyde/alcohol dehydrogenases into a cell can increase the production of ethanol. However, because the production of ethanol is redox neutral, an acetaldehyde/alcohol dehydrogenase activity cannot serve as an alternative for the redox balancing that the production of glycerol provides to a cell in anaerobic metabolism. When Medina attempted to express an acetylaldehyde dehydrogenase, mhpF, from *E. coli* in an *S. cerevisiae* gpd1/2 deletion strain, the strain did not grow under anaerobic conditions in the presence of glucose as the sole source of carbon. Medina, V. G., et al., *Appl. Env. Microbiol.* 76:190-195 (2010); see also EP 2277989. Rather, the anaerobic growth of the glycerol-deletion strain required the presence of acetic acid. However, an acetylaldehyde dehydrogenase has not been expressed in combination with PFL or with the recombinant host cells of the invention. Additionally, replacing the endogenous acetylaldehyde dehydrogenase activity with either an improved acetaldehyde dehydrogenase or using a bifunctional acetaldehyde/alcohol dehydrogenase (AADH) can positively affect the in vivo kinetics of the reaction providing for improved growth of the host strain.

Improving Conversion of Acetyl-CoA to Ethanol

To improve the conversion of acetyl-CoA to ethanol, endogenous yeast genes can be replaced or complimented with either an improved acetaldehyde dehydrogenase (e.g., from *C. phytofermentans* or other source) to convert acetyl-CoA to acetaldehyde, or a bifunctional acetaldehyde/alcohol dehydrogenase (AADH) to convert acetyl-CoA to acetaldehyde and acetaldehyde to ethanol. By engineering in one or more such enzymes, the in vivo kinetics of the conversion of acetyl-CoA to ethanol can be increased, providing for improved growth of the host strain. The bi-functional alcohol/aldehyde dehydrogenase can come from a variety of microbial sources, including but not limited to *E. coli, C. acetobutylicum, T. saccharolyticum, C. thermocellum, C phytofermentans, Piromyces* SP E2, or *Bifidobacterium adolescentis*.

When glycerol deletion strains are grown anaerobically, they are not capable of growth or fermentation and cannot consume sugar during glycolysis. However, if these glycerol deletion strains are complemented with an AADH, the strains are able to grow with the supplementation of acetate in the media.

AADH enzymes for use in the recombinant host cells of the invention can come from a bacterial or eukaryotic source. Examples of bacterial AADH include, but are not limited to, *Clostridium phytofermentans, Escherichia coli, Bacillus coagulans, Bacillus lentus, Bacillus licheniformis, Bacillus pumilus, Bacillus subtilis, Bacteroides amylophilus, Bacteroides capillosus, Bacteroides ruminocola, Bacteroides suis, Bifidobacterium adolescentis, Bifidobacterium animalis, Bifidobacterium bifidum, Bifidobacterium infantis, Bifidobacterium longum. Bifidobacterium thermophilum, Lactobacillus acidophilus, Lactobacillus brevis, Lactobacillus buchneri* (cattle only), *Lactobacillus bulgaricus, Lactobacillus casei, Lactobacillus cellobiosus, Lactobacillus curvatus, Lactobacillus delbruekii, Lactobacillus farciminis* (swine only), *Lactobacillus fermentum, Lactobacillus helveticus, Lactobacillus lactis, Lactobacillus plantarum, Lactobacillus reuterii, Leuconostoc mesenteroides, Pediococcus acidilacticii, Pediococcus pentosaceus, Propionibacterium acidpropionici* (cattle only), *Propionibacterium freudenreichii, Propionibacterium shermanii, Enterococcus cremoris, Enterococcus diacetylactis, Enterococcus faecium, Enterococcus intermedius, Enterococcus lactis*, or *Enterococcus thermophiles*.

Xylose Metabolism

Xylose is a five-carbon monosaccharide that can be metabolized into useful products by a variety of organisms. There are two main pathways of xylose metabolism, each unique in the characteristic enzymes they utilize. One pathway is called the "Xylose Reductase-Xylitol Dehydrogenase" or XR-XDH pathway. Xylose reductase (XR) and xylitol dehydrogenase (XDH) are the two main enzymes used in this method of xylose degradation. XR, encoded by the XYL1 gene, is responsible for the reduction of xylose to xylitol and is aided by cofactors NADH or NADPH. Xylitol is then oxidized to xylulose by XDH, which is expressed through the XYL2 gene, and accomplished exclusively with the cofactor $NAD^+$. Because of the varying cofactors needed in this pathway and the degree to which they are available for usage, an imbalance can result in an overproduction of xylitol byproduct and an inefficient production of desirable ethanol. Varying expression of the XR and XDH enzyme levels have been tested in the laboratory in the attempt to optimize the efficiency of the xylose metabolism pathway.

The other pathway for xylose metabolism is called the "Xylose Isomerase" (XI) pathway. Enzyme XI is responsible for direct conversion of xylose into xylulose, and does not proceed via a xylitol intermediate. Both pathways create xylulose, although the enzymes utilized are different. After production of xylulose both the XR-XDH and XI pathways proceed through the enzyme xylulokinase (XK), encoded on gene XKS1, to further modify xylulose into xylulose-5-phosphate where it then enters the pentose phosphate pathway for further catabolism.

Studies on flux through the pentose phosphate pathway during xylose metabolism have revealed that limiting the speed of this step may be beneficial to the efficiency of fermentation to ethanol. Modifications to this flux that may improve ethanol production include a) lowering phosphoglucose isomerase activity, b) deleting the GND1 gene, and c) deleting the ZWF1 gene (Jeppsson et al., *Appl. Environ. Microbiol.* 68:1604-09 (2002)). Since the pentose phosphate pathway produces additional NADPH during metabolism, limiting this step will help to correct the already evident imbalance between $NAD(P)H$ and $NAD^+$ cofactors and reduce xylitol byproduct. Another experiment comparing the two xylose metabolizing pathways revealed that the XI pathway was best able to metabolize xylose to produce the greatest ethanol yield, while the XR-XDH pathway reached a much faster rate of ethanol production (Karhumaa et al., *Microb Cell Fact*. 2007 Feb. 5; 6:5). See also International Publication No. WO2006/009434, incorporated herein by reference in its entirety.

In some embodiments, the recombinant microorganisms of the invention have the ability to metabolize xylose using one or more of the above enzymes.

Arabinose Metabolism

Arabinose is a five-carbon monosaccharide that can be metabolized into useful products by a variety of organisms. L-Arabinose residues are found widely distributed among many heteropolysaccharides of different plant tissues, such as arabinans, arabinogalactans, xylans and arabinoxylans. *Bacillus* species in the soil participate in the early stages of plant material decomposition, and *B. subtilis* secretes three enzymes, an endo-arabanase and two arabinosidases, capable of releasing arabinosyl oligomers and L-arabinose from plant cell.

Three pathways for L-arabinose metabolism in microorganisms have been described. Many bacteria, including *Escherichia coli*, use arabinose isomerase (AraA; E.C. 5.3.1.4), ribulokinase (AraB; E.C. 2.7.1.16), and ribulose phosphate epimerase (AraD; E.C. 5.1.3.4) to sequentially convert L-arabinose to D-xylulose-5-phosphate through L-ribulose and L-ribulose 5-phosphate. See, e.g., Sa-Nogueira I, et al., *Microbiology* 143:957-69 (1997). The D-xylulose-5-phosphate then enters the pentose phosphate pathway for further catabolism. In the second pathway, L-arabinose is converted to L-2-keto-3-deoxyarabonate (L-KDA) by the consecutive action of enzymes arabinose dehydrogenase (ADH), arabinolactone (AL), and arabinonate dehydratase (AraC). See, e.g., Watanabe, S, et al., *J. Biol. Chem*. 281: 2612-2623 (2006). L-KDA can be further metabolized in two alternative pathways: 1) L-KDA conversion to 2-ketoglutarate via 2-ketoglutaric semialdehyde (KGSA) by L-KDA dehydratase and KGSA dehydrogenase or 2) L-KDA conversion to pyruvate and glycolaldehyde by L-KDA aldolase. In the third, fungal pathway, L-arabinose is converted to D-xylulose-5-phosphate through L-arabinitol, L-xylulose, and xylitol, by enzymes such as NAD(P)H-dependent aldose reductase (AR), L-arabinitol 4-dehydrogenase (ALDH), L-xylulose reductase (LXR), xylitol dehydrogenase (XylD), and xylulokinase (XylB). These, and additional proteins involved in arabinose metabolism and regulation may be found at http://www.nmpdr.org/FIG/wikilrest.cgi/NmpdrPlugin/SeedViewer?page=Subsystems;subsystem=L-Arabinose_utilization, visited Mar. 21, 2011, which is incorporated by reference herein in its entirety.

AraC protein regulates expression of its own synthesis and the other genes of the Ara system. See Schleif, R., *Trends Genet.* 16(12):559-65 (2000). In the *E. coli*, the AraC protein positively and negatively regulates expression of the proteins required for the uptake and catabolism of the sugar L-arabinose. Homologs of AraC, such as regulatory proteins RhaR and RhaS of the rhamnose operon, have been identified that contain regions homologous to the DNA-binding domain of AraC (Leal, T. F. and de Sa-Nogueira, I., *FEMS Microbiol Lett.* 241(1):41-48 (2004)). Such arabinose regulatory proteins are referred to as the AraC/XylS family. See also, Mota, L. J., et al., *Mol. Microbiol.* 33(3):476-89 (1999); Mota, L. J., et al., *J Bacteriol.* 183(14):4190-201 (2001).

In *E. coli*, the transport of L-arabinose across the *E. coli* cytoplasmic membrane requires the expression of either the high-affinity transport operon, araFGH, a binding protein-dependent system on the low-affinity transport operon, araE, a proton symporter. Additional arabinose transporters include those identified from *K. marxianus* and *P. guilliermondii*, disclosed in U.S. Pat. No. 7,846,712, which is incorporated by reference herein.

In some embodiments, the recombinant microorganisms of the invention have the ability to metabolize arabinose using one or more of the above enzymes.

The following embodiments of the invention will now be described in more detail by way of these non-limiting Examples.

EXAMPLES

Example 1

Expression of Fungal Lignocellulase System Components in Yeast

Figure 1:
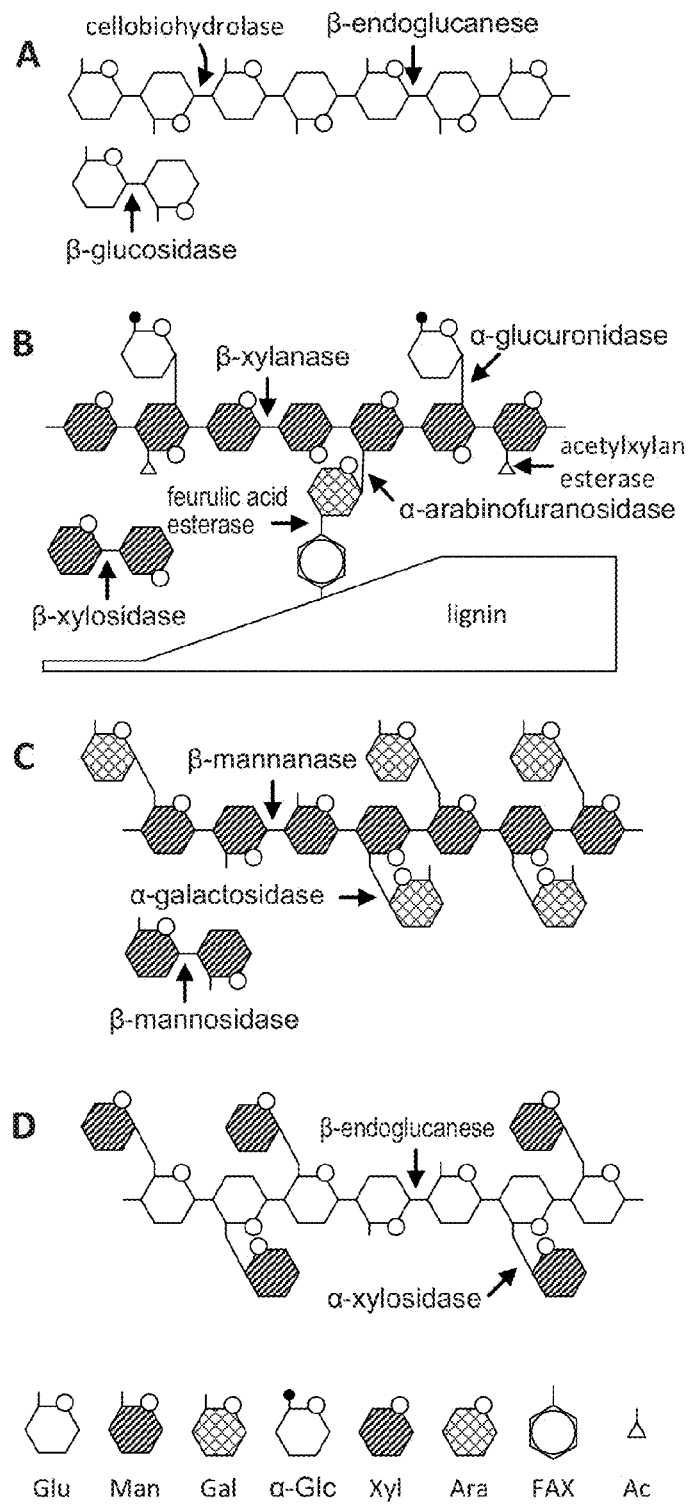
FIG. 1 depicts the complexity of cellulose and hemicellulose and the enzymes involved in their degradation. Cellulose (a) and hemicellulose structures for arabinoxylan (b), galactomannan (c), and xyloglucan (d) depicting the different side chains present. Hexoses are distinguished from pentoses by the presence of a protruding line from the cyclic hexagon (pyranose ring), depicting the $CH_2OH$ group. Hydrolase enzymes and the bonds targeted for cleavage in the four polysaccharide structures are indicated by arrow.
Figure 2:
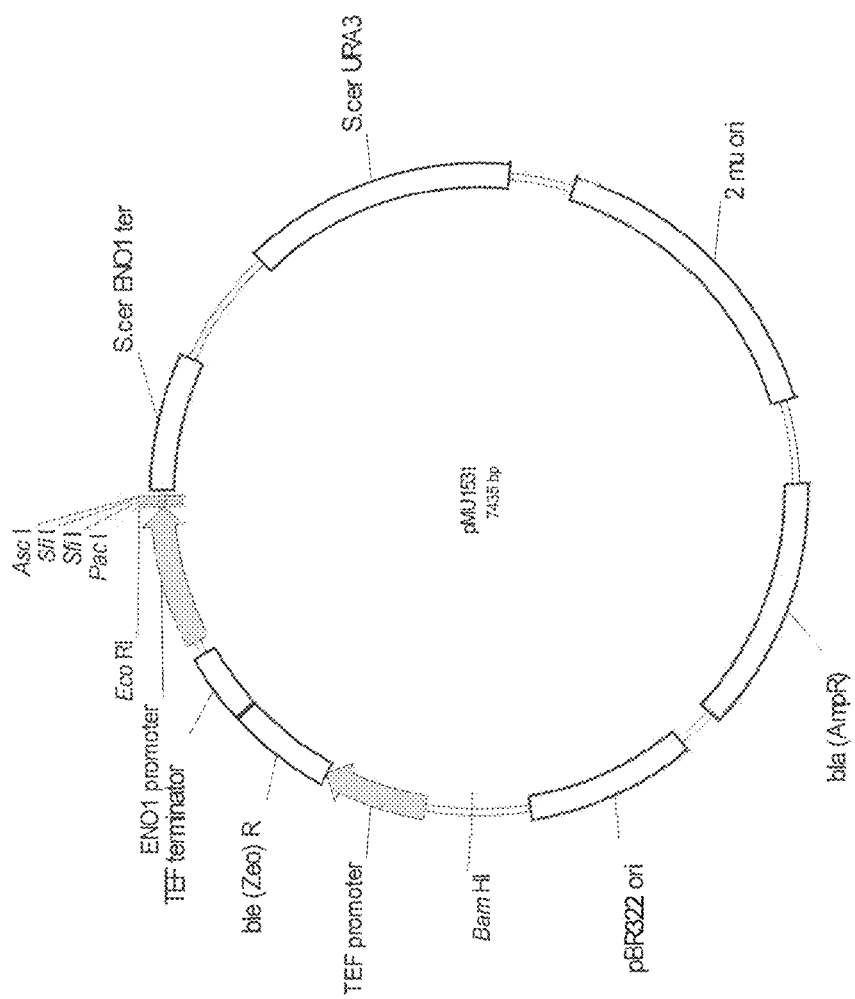
FIG. 2 depicts a basic cloning and expression vector for testing cellulases (pMU1531). This vector is an episomal 2-μ yeast expression vector used for expression of genes in yeast. ENO1 promoter—*S. cerevisiae* ENO1 promoter; S.cer ENO1 ter—*S. cerevisiae* ENO1 terminator, S.cer. URA3—*S. cerevisiae* URA3 auxotrophic marker; 2 mu ori—2μ *S. cerevisiae* plasmid origin of replication; bla(AmpR)—Amp resistance marker; pBR322—*E. coli* pB322 plasmid origin of replication; TEF1 pr—*Ashbya gossypii* TEF1 promoter; TEF1 ter—*A. gossypii* TEF1 terminator; ble (Zeo) R—*Streptoalloteichus hindustanus* ble Zeocin resistance gene.

In order to generate strains expressing these various enzymes, and in anticipation of co-expressing them, several promoter and terminator pairs were created to use as expression vectors. The promoter terminator pairs, and the enzyme types that were tested under their control are listed in Table 3. Genes encoding various enzyme activities were cloned into vector pMU1531 by standard molecular biology procedures (See e.g. Maniatis, "Molecular Cloning" Cold Spring Harbor Press). FIG. 2 gives a schematic of pMU1531 which was the backbone cloning vector used. This vector contains the ENO1 promoter and terminator from *S. cerevisiae* and the URA3 and zeocin markers for use in yeast. It was subsequently modified to have the various promoter/terminator combinations listed in Table 3.

TABLE 3

Promoters and terminators used for expression of fungal and bacterial genes.

| # | Promoter | Terminator | Genes expressed |
|---|----------|------------|-----------------|
| 1 | ENO1 | ENO1 | EG1, EG2, EG3, xylanase (GH11 and GH10), xylosidase (GH43, GH3), complete bacterial library |
| 2 | ENO1 | PYK1 | EG1 |
| 3 | ADH1 | PDC1 | fungal GH10 xylanase, Cy Xyl10 (bacterial) |
| 4 | ADH2 | CYC1 | Beta-mannase, GH11 xylanase |
| 5 | ENO2 | TDH3 | EG6 |
| 6 | FBA1 | PGI1 | EG4 |
| 7 | GPM1 | TPI1 | EG5 |
| 8 | HXT7 | PMA1 | GH3 xylosidase, CIP1 |
| 9 | PDC1 | ENO2 | TfCel9A, GH74 xyloglucanase |
| 10 | PGI1 | HXT7 | GH10 xylanase |
| 11 | PMA1 | ADH1 | EG2, |
| 12 | TDH3 | GPM1 | GH43 xylosidase |
| 13 | TPI1 | FBA1 | EG3 |
| 14 | HXT2 | ACT1 | GH27 (AGLI) |
| 15 | PFK1 | HXT2 | CE1 (AXE) |
| 16 | HXT3 | PFK1 | GH62 (AXH) |
| 17 | PFK2 | HXT3 | CE1 (FAEA) |
| 18 | PYK1 | PFK2 | CE1 (FAEB) |
| 19 | TEF1 | ADH2 | SWO |
| 20 | ADH3 | TEF1 | GH2 (beta-mannosidase) |
| 21 | TEF2 | ADH3 | GH67 (alpha-glucuronidase) |
| 22 | GND1 | TEF2 | CIP2 |
| 23 | ACT1 | GND1 | GH54 (ABF1) |
| 24 | TAL1 | SOL1 | alpha-expansin |
| 25 | TKL1 | ADH5 | beta-expansin |

TABLE 4

Fungal enzyme system components expressed in yeast.

| Cazy family/ enzyme type/ synonym | Activity | Organism | Accession # | Strain # | Plasmid # |
|---|---|---|---|---|---|
| GH7B (EG1) | Endoglucanase | *Aspergillus fumigatus* | XP_747897 | M1311 | pMU1626 |
| GH7B (EG1) | Endoglucanase | *Neosartorya fischeri* | XP_001257357 | M1312 | pMU1627 |
| GH7B (EG1) | Endoglucanase | *Aspergillus clavatus* | XP_001270378 | M1313 | pMU1628 |
| GH7B (EG1) | Endoglucanase | *Aspergillus terreus* | XP_001217291 | M1270 | pMU1561 |
| GH7B (EG1) | Endoglucanase | *Trichoderma longibrachiatum* | ACZ34302 | M1317 | pMU1632 |
| GH7B (EG1) | Endoglucanase | *Penicillium marneffei* | XP_002152969 | M1318 | pMU1633 |
| GH7B (EG1) | Endoglucanase | *Chaetomium globosum* | XP_001229968 | M1310 | pMU1625 |
| GH7B (EG1) | Endoglucanase | *Neurospora crassa* | XP_956431 | M1271 | pMU1562 |
| GH7B (EG1) | Endoglucanase | *Aspergillus oryzae* | BAA22589 | M1314 | pMU1629 |

TABLE 4-continued

Fungal enzyme system components expressed in yeast.

| Cazy family/ enzyme type/ synonym | Activity | Organism | Accession # | Strain # | Plasmid # |
|---|---|---|---|---|---|
| GH7B (EG1) | Endoglucanase | Thielavia heterothallica | AAE25067 | M1315 | pMU1630 |
| GH7B (EG1) | Endoglucanase | Fusarium oxysporum | AAG09047 | M1272 | pMU1563 |
| GH7B (EG1) | Endoglucanase | Humicola insolens | 1DYM_A | M1316 | pMU1631 |
| GH7B (EG1) | Endoglucanase | Pyrenophora tritici-repentis | XP_001935476 | M1319 | pMU1634 |
| GH7B (EG1) | Endoglucanase | Magnaporthe grisea | XP_370166 | M1273 | pMU1564 |
| GH7B (EG1) | Endoglucanase | Fusarium graminearum | XP_388429 | M1274 | pMU1565 |
| GH7B (EG1) | Endoglucanase | Hypocrea jecorina | P07981 | M1276 | pMU1574 |
| GH5 (EG2) | Endoglucanase | Hypocrea jecorina | P07982 | M1138 | pMU1400 |
| GH5 (EG2) | Endoglucanase | Chrysosporium lucknowense | | RDH160 | pRDH160 |
| GH5 (EG2) | Endoglucanase | Polyporus arcularius | BAF75943.1 | RDH163 | pRDH163 |
| GH5 (EG2) | Endoglucanase | Aspergillus kawachii | BAB62317.1 | RDH145 | pRDH145 |
| GH5 (EG2) | Endoglucanase | Heterodera schachtii | CAC12958.1 | RDH146 | pRDH146 |
| GH5 (EG2) | Endoglucanase | Orpinomyces sp. | AAD04193.1 | RDH148 | pRDH148 |
| GH5 (EG2) | Endoglucanase | Irpex lacteus | BAD67544.1 | RDH149 | pRDH149 |
| GH5 (EG2) | Endoglucanase | Chaetomium globosum | XP_001220409.1 | RDH159 | pRDH159 |
| GH5 (EG2) | Endoglucanase | Aspergillus niger | XP_001397982.1 | RDH161 | pRDH161 |
| GH5 (EG2) | Endoglucanase | Penicillium decumbens | ABY28340.1 | RDH162 | pRDH162 |
| GH12A (EG3) | Endoglucanase | Trichoderma reesei | BAA20140 | RDH164 | pRDH164 |
| GH12A (EG3) | Endoglucanase | Phanerochaete chrysosporium | AAU12276 | RDH167 | pRDH167 |
| GH12A (EG3) | Endoglucanase | Stachybotrys echinata | AAM77710 | RDH165 | pRDH165 |
| GH12A (EG3) | Endoglucanase | Neosartorya fischeri | XP_001261563 | RDH166 | pRDH166 |
| GH12A (EG3) | Endoglucanase | Chaetomium brasiliense | AAM77701 | RDH168 | pRDH168 |
| GH61A (EG4) | Endoglucanase | Chaetomium globosum | EAQ86340 | M1391 | pMU1746 |
| GH61A (EG4) | Endoglucanase | Aspergillus fumigatus | CAF31975 | M1392 | pMU1747 |
| GH61A (EG4) | Endoglucanase | Humicola insolens | CAG27577 | M1393 | pMU1748 |
| GH61A (EG4) | Endoglucanase | Neosartorya fischeri | XP_001267517 | M1394 | pMU1749 |
| GH61A (EG4) | Endoglucanase | Thielavia terrestris | ACE10231 | M1418 | pMU1779 |
| GH45A (EG5) | Endoglucanase | Chrysosporium lucknowense | ACH15008 | M1395 | pMU1750 |
| GH45A (EG5) | Endoglucanase | Chaetomium globosum | XP_001226436 | M1420 | pMU1753 |
| GH45A (EG5) | Endoglucanase | Acremonium thermophilum | ACE10216 | M1421 | YML only |
| GH45A (EG5) | Endoglucanase | Humicola insolens | CAB42307 | M1396 | pMU1751 |
| GH45A (EG5) | Endoglucanase | Thielavia terrestris | CAH03187 | M1418 | pMU1779 |
| GH6 (EG6) | Endoglucanase | Chrysosporium lucknowense | AAQ38151 | M1422 | YML only |
| GH6 (EG6) | Endoglucanase | Magnaporthe grisea | EDJ97375 | M1397 | pMU1752 |
| GH6 (EG6) | Endoglucanase | Chaetomium globosum | EAQ84577 | M1398 | pMU1753 |
| GH6 (EG6) | Endoglucanase | Humicola insolens | 1DYS_B | M1399 | pMU1754 |
| GH6 (EG6) | Endoglucanase | Neurospera crassa | XP_957415 | M1400 | pMU1755 |
| GH74A (EGL6) | Xyloglucanase | Trichoderma reesei | AAP57752 | M1423 | YML only |
| GH74A (EGL6) | Xyloglucanase | Aspergillus niger | AAK77227 | M1424 | YML only |
| GH74A (EGL6) | Xyloglucanase | Aspergillus aculeatus | BAA29031 | M1425 | YML only |
| GH74A (EGL6) | Xyloglucanase | Neosartorya fischeri | XP_001261776 | M1426 | YML only |

TABLE 4-continued

Fungal enzyme system components expressed in yeast.

| Cazy family/ enzyme type/ synonym | Activity | Organism | Accession # | Strain # | Plasmid # |
|---|---|---|---|---|---|
| GH11 | Endoxylanase | Chaetomium thermophilum | CAD48749 | RDH170 | pRDH170 |
| GH11 | Endoxylanase | Trichoderma reesei (synthetic version) | ABK59833 | RDH169 | pRDH169 |
| GH11 | Endoxylanase | Trichoderma reesei (native version) | ABK59833 | RDH182 | pRDH182 |
| GH10 | Endoxylanase | Chrysosporium lucknowense | AAQ38147 | RDH183 | pRDH183 |
| GH10 | Endoxylanase | Aureobasidium pullulans | BAE71410 | RDH171 | pRDH171 |
| GH3 | beta-xylosidase | Aspergillus niger | XP_001389416 | RDH181 | pRDH181 |
| GH3 | beta-xylosidase | Aspergillus nidulans | CAA73902 | RDH179 | pRDH179 |
| GH43 (BXL1) | beta-xylosidase | Cochliobolus carbonum | AAC67554 | RDH175 | pRDH175 |
| GH43 (BXL1) | beta-xylosidase | Penicillium herquei | BAC75546 | RDH176 | pRDH176 |
| GH43 (BXL1) | beta-xylosidase | Pyrenophora tritici-repentis | XP_001940956 | RDH177 | pRDH177 |
| MAN1 | beta-mannase (endo-enzyme) | Aspergillus aculeatus | AAA67426 | | pMU1903 |
| GH2 | beta-mannosidase (exo-enzyme) | Aspergillus niger | Q9UUZ3 | M1491 | pMU1912 |
| GH2 | beta-mannosidase (exo-enzyme) | Aspergillus aculeatus | BAA29029 | M1492 | pMU1913 |
| GH2 | beta-mannosidase (exo-enzyme) | Neosartorya fischeri | XP_001258000 | M1493 | pMU1914 |
| GH67 | alpha-glucuronidase | Trichoderma reesei | CAA92949 | M1494 | pMU1915 |
| GH67 | alpha-glucuronidase | Aspergillus niger | CAC38119 | M1547 | YML only |
| GH67 | alpha-glucuronidase | Talaromyces emersonii | AAL33576 | M1549 | YML only |
| CE1 (AXE) | acetylxylanesterase | Aspergillus niger | XP_001395572 | M1513 | pMU1933 |
| CE1 (AXE) | acetylxylanesterase | Trichoderma reesei | Q99034 | M1512 | pMU1932 |
| CE1 (AXE) | acetylxylanesterase | Neosartorya fischeri | XP_001262186 | M1514 | pMU1934 |
| GH27 (AGLI) | alpha-galactosidase (AGLI) | Trichoderma reesei | CAA93244 | M1550 | YML only |
| GH54 (ABF1) | arabinofuranosidase | Aspergillus niger | AAA93264 | M1511 | pMU1930 |
| GH62 (ABF2, AXHA) | arabinofuranosidase, 1,4-beta-D-arabinoxylan arabinofuranohydrolase | Trichoderma reesei | AAP57750 | M1483 | pMU1904 |
| GH62 (ABF2, AXHA) | arabinofuranosidase, 1,4-beta-D-arabinoxylan arabinofuranohydrolase | Chaetomium globosum | XP_001223478 | M1479 | pMU1885 |
| GH62 (ABF2, AXHA) | arabinofuranosidase, 1,4-beta-D-arabinoxylan arabinofuranohydrolase | Aspergillus niger | XP_001389998 | M1481 | pMU1890 |
| SWO (expansin) | Swollenin | Penicillium decumbens | ACH57439 | M1471 | pMU1876 |
| SWO (expansin) | Swollenin | Neosartorya fischeri | XP_001257521 | M1472 | pMU1877 |
| SWO (expansin) | Swollenin | Talaromyces stipitatus | EED19018 | M1473 | pMU1878 |
| SWO (expansin) | Swollenin | Trichoderma reesei | CAB92328 | M1515 | pMU1931 |
| CIP1 | Unknown | Trichoderma reesei | AAP57751 | M1484 | pMU1905 |
| CIP1 | Unknown | Chaetomium globosum | XP_001228455 | M1485 | pMU1906 |
| CIP1 | Unknown | Magnaporthe grisea | XP_365869 | M1486 | pMU1907 |

TABLE 4-continued

Fungal enzyme system components expressed in yeast.

| Cazy family/ enzyme type/ synonym | Activity | Organism | Accession # | Strain # | Plasmid # |
|---|---|---|---|---|---|
| CIP2 | glucuronyl esterase | Trichoderma reesei | AAP57749 | M1482 | pMU1891 |
| CIP2 | glucuronyl esterase | Chaetomium globosum | XP_001226041 | M1474 | pMU1879 |
| CIP2 | glucuronyl esterase | Aspergillus fumigatus | XP_751313 | M1480 | pMU1886 |
| alpha-expansin | alpha-expansin | Populus alba | BAB39482 | M1488 | pMU1909 |
| alpha-expansin | alpha-expansin | Vitis lubrusca | BAC66697 | M1487 | pMU1908 |
| beta-expansin | beta-expansin | Triticum aestivum | AAS48881 | M1490 | pMU1911 |
| beta-expansin | beta-expansin | Eucalyptus globulus | AAZ08315 | M1489 | pMU1910 |
| CE1 (FAEA) | Feruoyl esterase (FAEA) | Aspergillus niger | XP_001393337 | M1475 | pMU1880 |
| CE1 (FAEA) | Feruoyl esterase (FAEA) | Aspergillus terreus | XP_001211092 | Please provide | pMU1884 |
| CE1 (FAEB) | Feruoyl esterase (FAEB) | Talaromyces stipitatus | EED17739 | M1476 | pMU1881 |
| CE1 (FAEB) | Feruoyl esterase (FAEB) | Chaetomium globosum | XP_001228412 | M1477 | pMU1882 |

Example 2

Characterizing the Expression and Activity of Auxiliary Cellulases

Figure 3A:
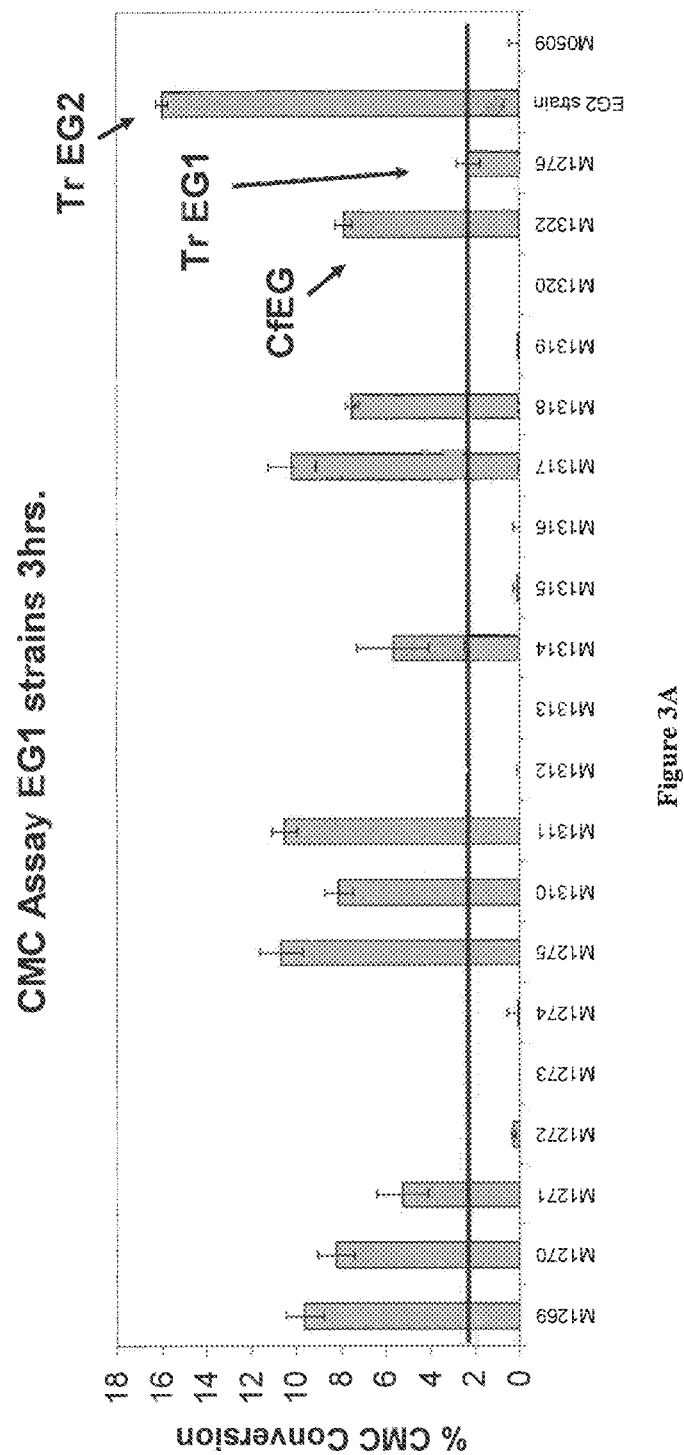
FIG. 3A depicts CMC and FIG. 3B depicts avicel assay results for EG1 candidates expressed in M0509. All EG1 constructs were tested under the control of the ENO1 promoter and terminator. Strain M1322 is expressing an EG from the termite *C. formosanus*. *T. reesei* EG1 and *T. reesei* EG2 were included as controls.
Figure 3B:
Figure 4:
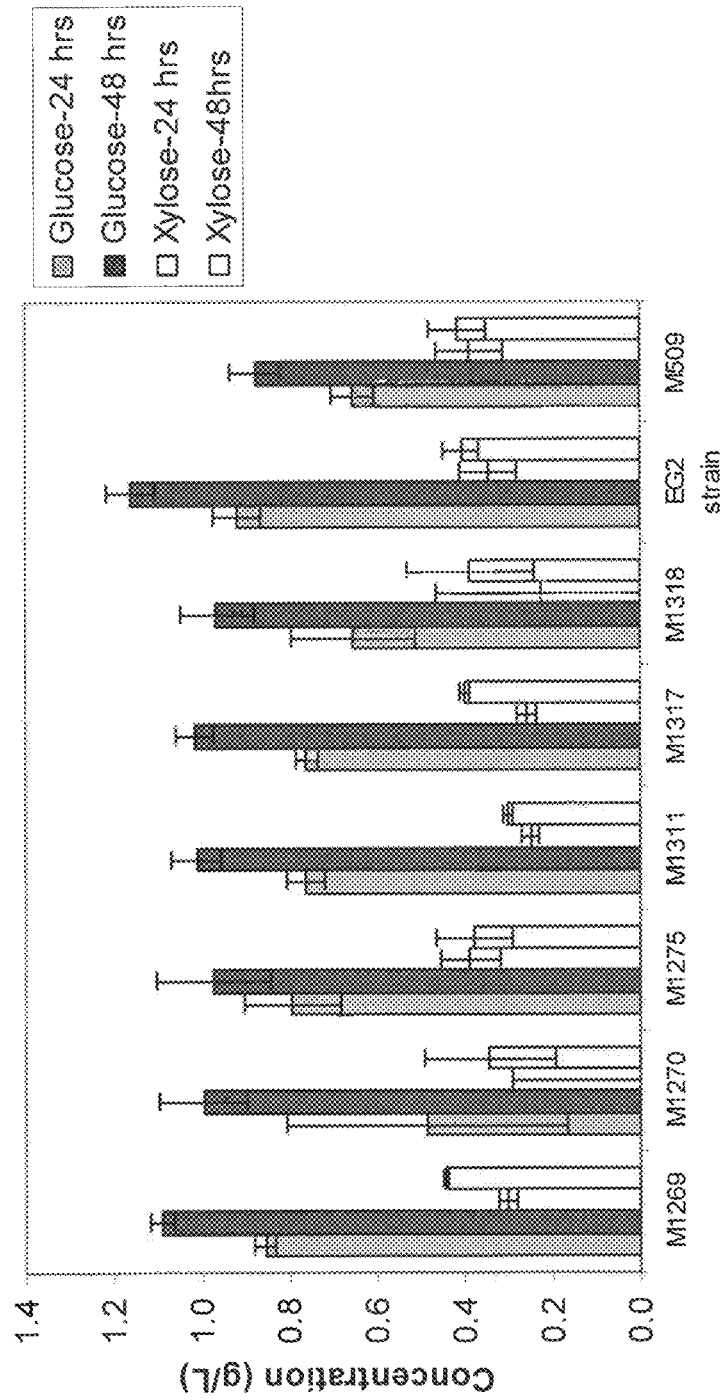
FIG. 4 depicts results from a pretreated hardwood (PHW) assay for the top 6 EG1 candidates, mixed with yeast made, purified, TeCBH1w/TrCBD, and ClCBH2, and Novozyme 188.
Figure 5:
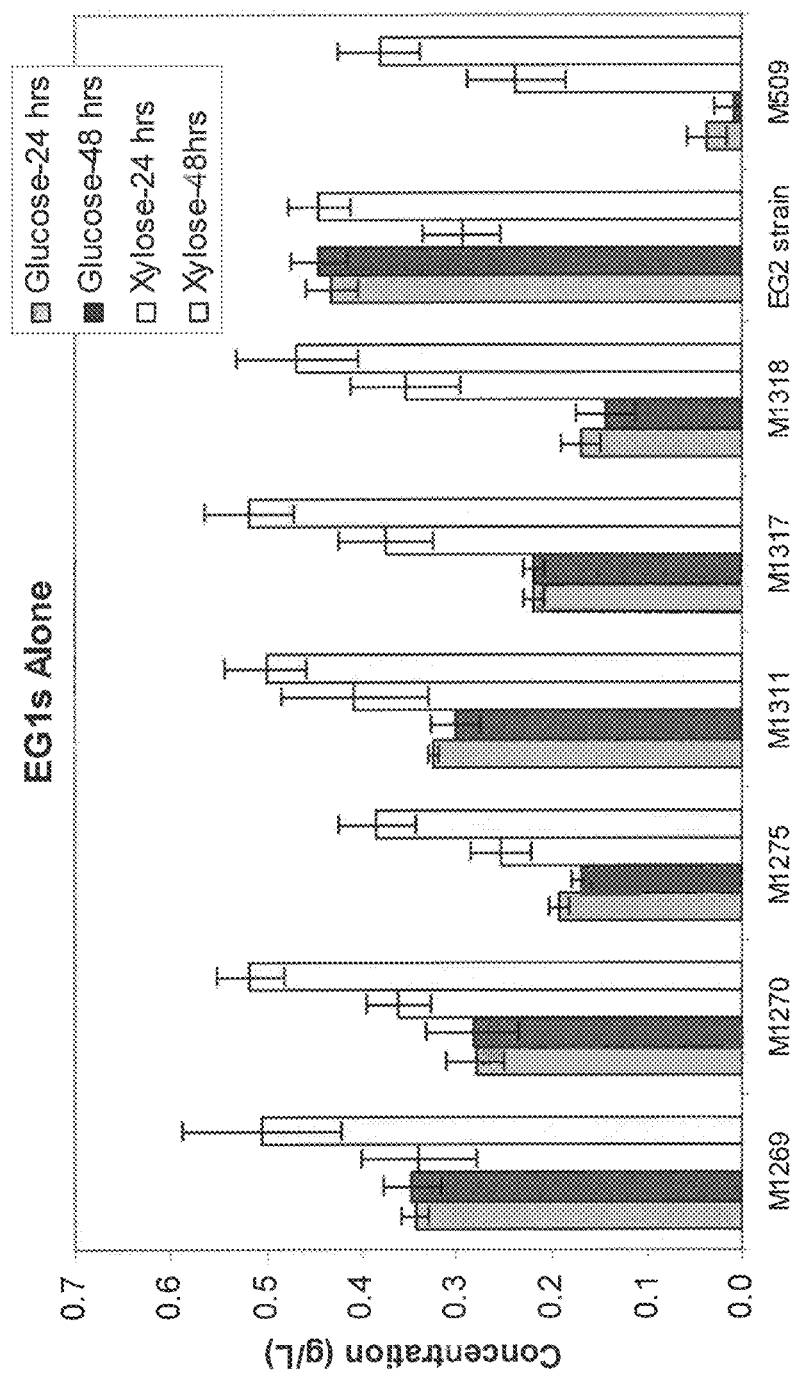
FIG. 5 depicts results of a PHW assay for EG1 candidates in the presence of Novozyme 188.

Following strain construction, strains expressing the fungal EG1 candidates were grown in 50 mL shake flask cultures with 100 ug/mL zeocin and tested for activity on CMC and avicel. FIG. 3 demonstrates that several active EG1s were found and that several were superior in activity to the comparable enzyme previously used (*Trichoderma reesei* EG1, M1276). From these data, the top 6 candidates were selected based on activity on avicel for further testing on PHW (FIGS. 4 and 5).

The PHW assay was carried out with a pretreated wood substrate (MS149), both in the presence and absence of yeast made, purified CBH1 and CBH2 (2 mg/g of each), and Novozyme 188 BGL. 2 mL of supernatant was used from each EG1 expressing strain in the assay. A strain expressing TrEG2 from the same plasmid was again used as a control. The results from these assays can be found in FIGS. 4 and 5. Several EG1s showed the ability to act with CBH1 and CBH2 to increase hydrolysis, although not to the level that TrEG2 is capable of. Similarly, several EG1s showed the ability to release glucose from PHW in the presence of Novozymes 188 (a crude beta-glucosidase preparation containing several activities beyond BGL), and several also showed more xylose release than just the strain background alone.

Given the strong performance of M1311 in CMC, avicel and PHW assays, and the fact that it has a native CBD, the *Aspergillus fumigatus* enzyme was chosen as the best EG1 candidate.

In order to investigate other EG2-type endoglucanases and to investigate EG3-type endoglucanases for enhancement of current cellulase expression configurations. The choice of additional cel5 sequences was based on sequences with relatively good homology to the *T. reesei* eg2 or *Aspergillus kawachii* egA, the most successfully expressed cel5 genes from the first round of testing. The choice of cel12 sequences to be tested was based on sequences with relatively good homology to the *T. reesei* eg3 although sequences with homology greater than 95% were disregarded. Table 4 indicates the genes chosen for synthesis as well as the designation of the expression vector. All the genes were cloned under control of the ENO1 promoter/terminator using the pMU1531 expression plasmid.

The plasmids were all transformed to *S. cerevisiae* M0509 (an industrially hearty strain expressing xylose isomerase) using YPD containing 250 µg/ml zeocin as selective medium and transformants were confirmed with PCR. Along with the reference strain (containing pMU1531) and a strain expressing the *T. reesei* eg2 (pRDH180), the eg2/eg3 expressing strains were tested for activity on avicel and CMC. The strains were grown in YPD or double strength SC medium (3.4 g/L YNB; 3 g/L amino acid pool; 10 g/L ammonium sulfate; 20 g/L glucose) that was buffered to pH 6 (20 g/L succinic acid; 12 g/L NaOH, set pH to 6 with NaOH). Glucose was added after autoclaving of the other components from a 50% glucose stock solution. Zeocin was added to a final concentration of 100 µg/ml for liquid cultures. 10 mL cultures in 125 mL erlenmeyer flasks were grown at 30° C. for three days (YPD) or four days (SC).

Figure 6:
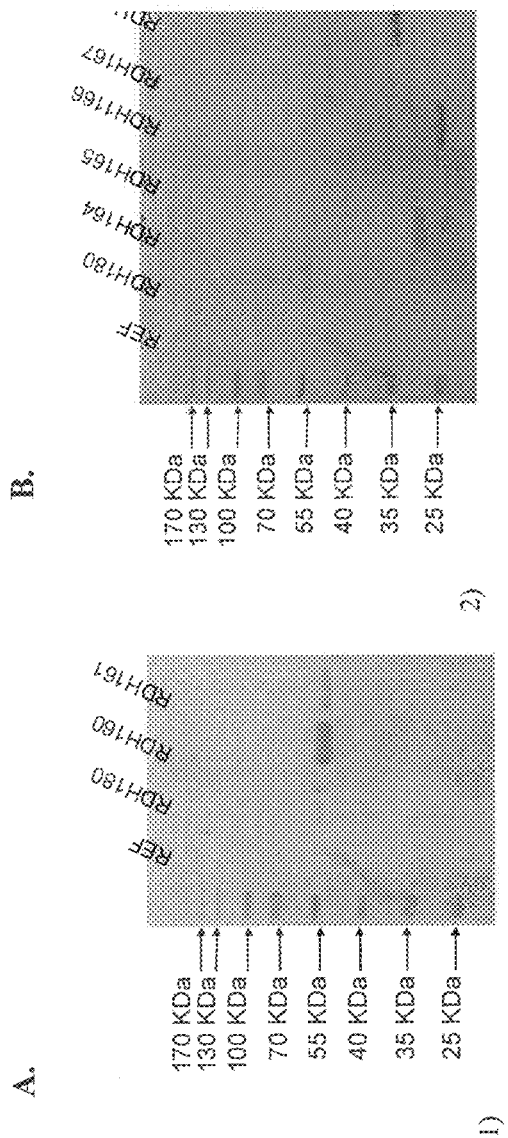
FIG. 6 depicts results of a SDS-PAGE analysis of the supernatants of (A) the EG2 and (B) the EG3 producing strains. A strain containing a plasmid with no foreign gene was used as reference strain (REF). The strain containing the plasmid pRDH180 expressing T.r.eg2, the most successful EG previously found, was also included.

Three flasks were inoculated for each strain. After incubation, samples were taken for gel analysis, protein determination and activity measurement. After centrifugation of the samples, 12 µl of each was taken, added to 5 µl of protein loading buffer and boiled for 5 minutes. The samples were subsequently loaded on a 10% SDS-PAGE and separated, followed by silver staining (FIG. 6).

From the gel it appeared that not all strains produced a visible band in the expected size range (see Table 5 for predicted sizes). The T.r.EG2 appeared as a band of about 55 kDa. As it was predicted to be approximately 44 kDa, the extra weight may represent hyperglycosylation. The EG2s of *C. lucknowense*, *A. niger*, and *P. decumbens* were also visible in the same approximate size range with the *P. decumbens* product being slightly smaller at ~50 kDa. From the gel it appeared that far more *C. lucknowense* EG2 protein was produced compared to the other EG2s. From FIG. 6B it was clear that there were no visible bands for the *S. echinata* or *P. chrysosporium* eg3 gene products. The *T. reesei*, *N. fischeri* and *C. brasiliense* eg3 gene products were visible as 30, 25 and 35 kDa bands, respectively. Again, the extra weight may represent hyperglycosylation. However, the *N. fischeri* Eg3 was found to be at or very near to its predicted size—this protein contains no putative N-glycosylation sites.

Figure 7:
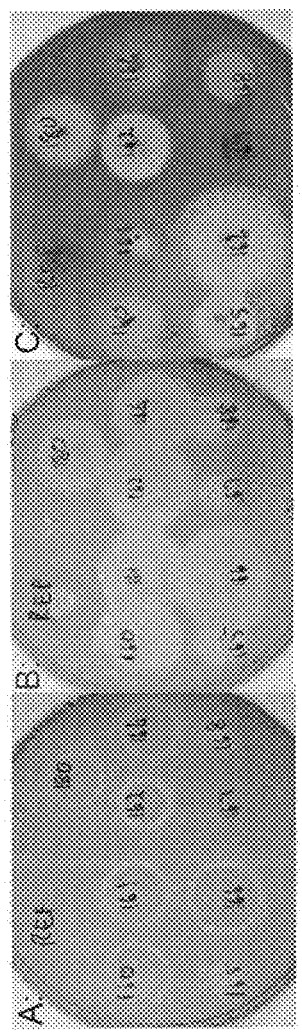
FIG. 7 depicts results of a CMC and a barley-β-glucan assay. Cultures were spotted on $SC^{-URA}$ plates containing 0.2% of either CMC (A and B) or barley-β-glucan (C). Numbers indicate the plasmid contained by each strain. pRDH180 contained the *T. reesii* eg2 and served as positive control. Plates were incubated for 3 (A) or 24 (B & C) hours at 30° C., after which colonies were washed of and the plates were stained with 0.1% congo red and de-stained with 1% NaCl.

To screen for EG activity, 5 µl of the cultures used for quantitative assays were spotted on SC$^{-URA}$ plates containing 0.2% of either CMC or barley-β-glucan (FIG. 7). Two CMC containing plates were made and stained after 3 or 24 hours. As can be seen from FIG. 7 the T.r.eg2 expressing strain (180) yielded very good clearing zones on both substrates. The other eg2 expressing strains also showed good clearing zone formation along with the strains expressing EG3's from T. reesei (164), S. echinata (165), N. fischeri (166) and C. brasiliense (168). The N. fischeri eg3 expressing strain (166) consistently yielded larger clearing zones than the other EGs on the plate assays. Due to the smaller size of this protein (FIG. 6B) and apparent lack of glycosylation this enzyme may have superior diffusion qualities in this media.

Figure 8:
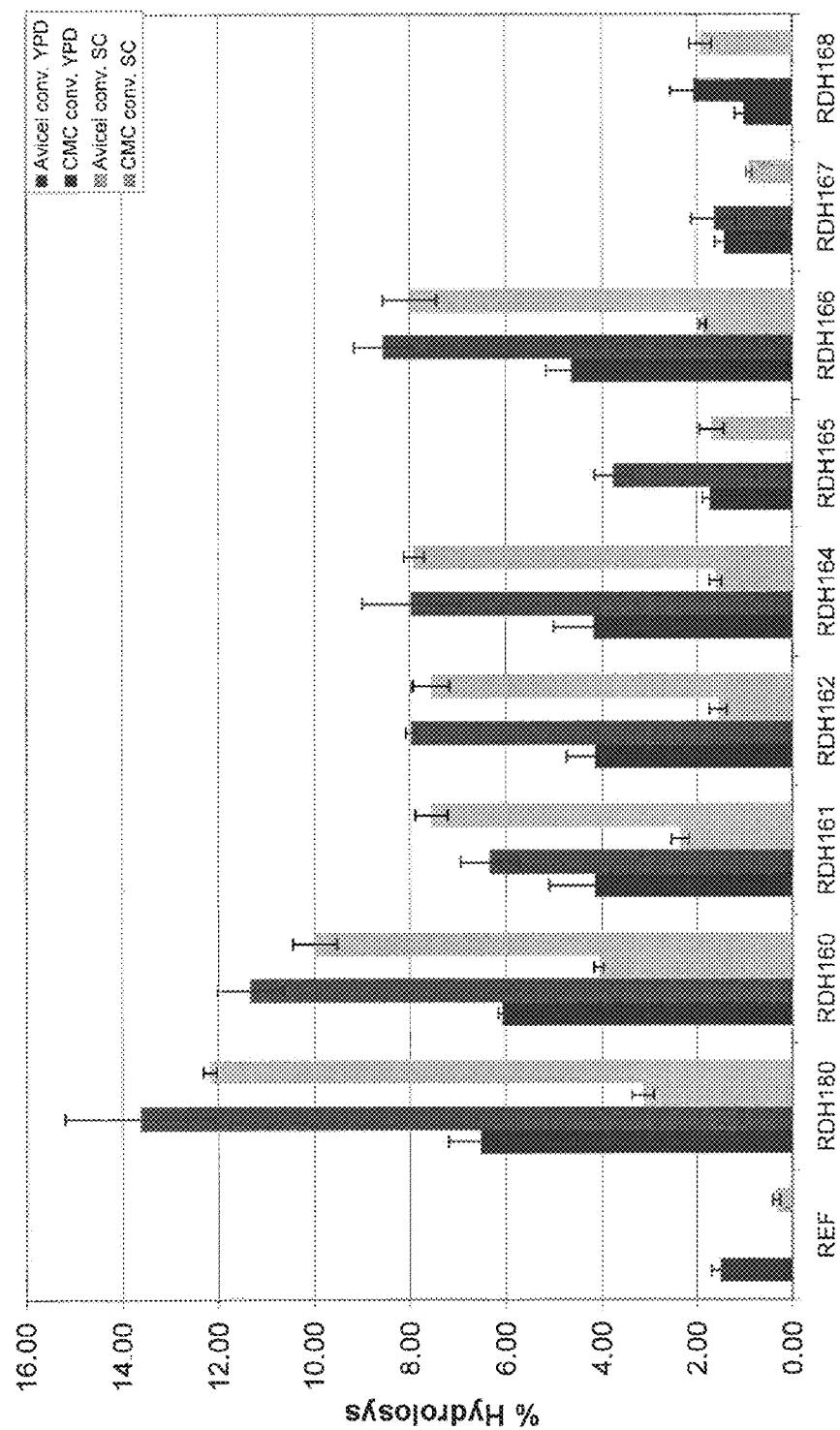
FIG. 8 depicts results from an assay measuring activity of YPD and SC cultured strains expressing EGs on avicel (24 hours) and CMC (3 hours). A strain containing a plasmid with no foreign gene was used as reference strain (REF) and the strain expressing T.r.eg2 (pRDH180) was included as positive control.

All strains were tested for activity using the high-throughput avicel conversion method as prescribed. Activity on CMC was determined with a similar assay while omitting the Novozyme 188 and starting with 1% CMC. The DNS used for the assay procedure contained phenol. Activity data from strains grown on YPD and SC can be seen in FIG. 8.

From the activity data it would appear that the strain expressing T. reesei eg2 (pRDH180) produced the highest levels of secreted activity. The EG2 from C. lucknowense displayed the next best activity on both substrates. The T. reesei EG3 and N. fischeri EG3 appear to be the superior enzymes for yeast expression from this group (cel12, will subsequently be tested on PHW).

Figure 9:
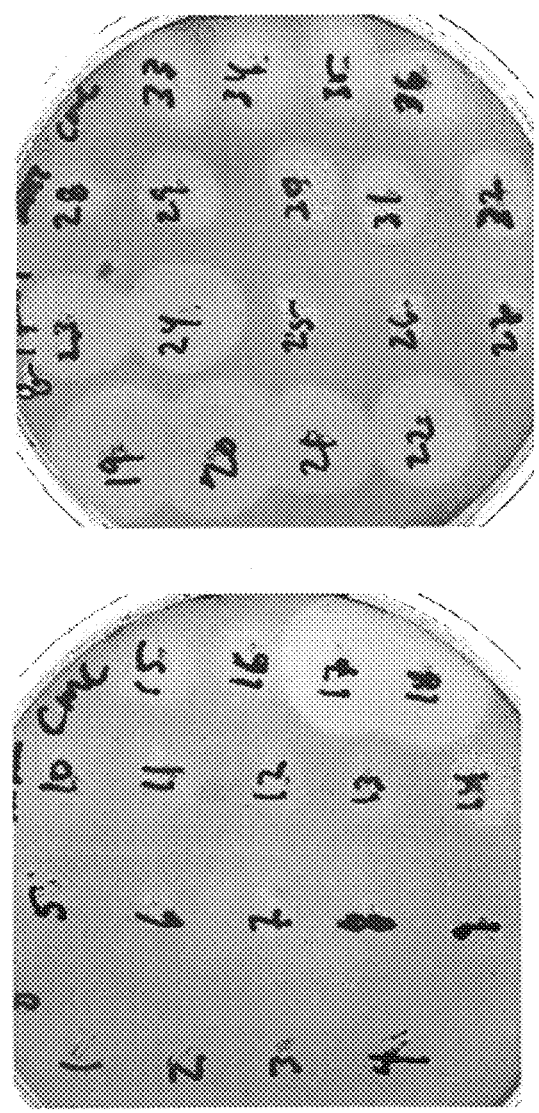
FIG. 9 depicts results of a CMC plate assay of EG4, EG5, and EG6 clones to verify activity expression of the genes.

Strain M0509 was also transformed with 2 um plasmids containing EG4s, EG5s, EG6s, and xyloglucanases (GH74/XG). These strains were then spotted on YNB plates with CMC, grown overnight at 30 degrees and stained with Congo red to check for activity of the cloned gene (Data for some of the strains shown in FIG. 9). The EG4 genes showed only weak activity on CMC, while both EG5 candidates showed large clearing zones, and all EG6s showed intermediate clearing zone size. The XG candidates all showed very small clearing zones on CMC. All enzyme types gave functional candidates.

Figure 10:
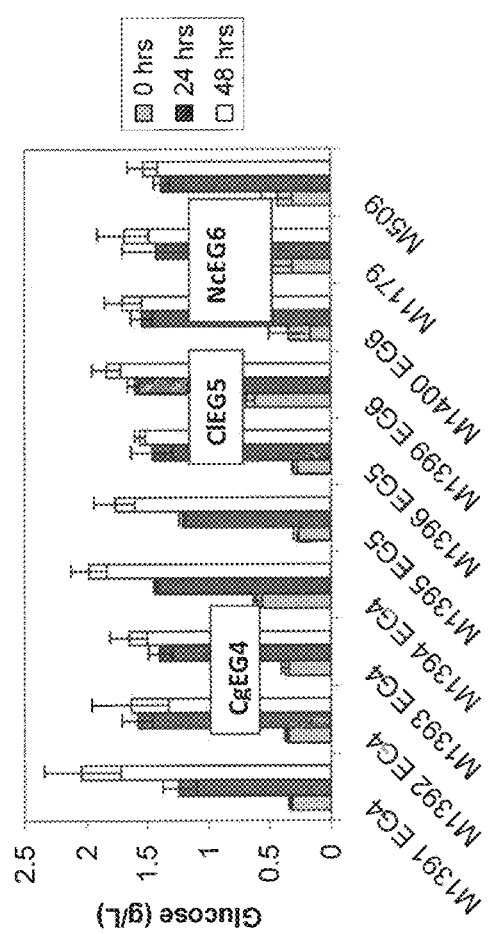
FIG. 10 depicts PHW assay results for candidate EG4s, EG5s, and EG6s.

The candidates were also tested for activity in the PHW assay in the presence of other enzymes. Purified, yeast made CBH1. CBH2, EG2, and BGL were used as partners for the assay loaded at a 4 mg enzyme protein per gram of solids, and a 40%:40%:15%:5% (by mass) mixture (FIG. 10). As controls, M0509 supernatant (negative) or M1179 supernatant (positive control strain expressing CBH1, CBH2, EG2, and BGL) were used.

The data in FIG. 10 demonstrate that addition of EG4 (from Chaetomium globosum or Neosartorya fischeri) or EG5 (from Chrysosporium lucknowense) can increase the hydrolysis of a 4 mg/g loading of CBHs. EG2, and BGL. When compared to loading an additional dose of CBH1, CBH2. EG2, and BGL (1179 supernatant), EG4 and EG5 give an increase in glucose release, although this difference does not appear to be statistically significant based on data from the glucose assay kit. Regardless, candidates for these 3 categories have been obtained, although several more remain to be screened.

Figure 11:
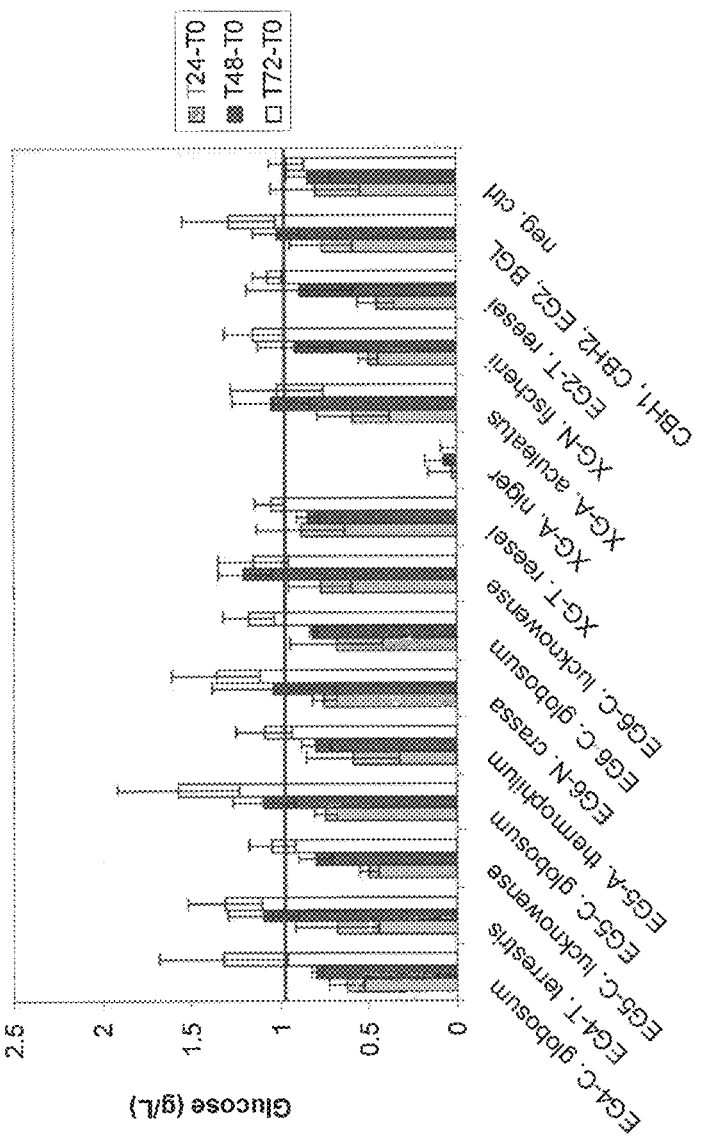
FIG. 11 depicts results from experiments with EG4, EG5, EG6, and xyloglucanase candidates by PHW assay. Cultures were grown in 15 mls of YPD for 2 days at 35 degrees in 50 ml tubes. Cultures were spun down and 2 mls of each supernatent was added to 2 mls of PHW components (Negative control is M0544, and M1179 expresses CBH1, CBH2, EG2, and BGL). 4 mg/g of purified enzymes was used as a screening partner in a ratio of 40:40:15:5 of CBH1:CBH2:EG2:BGL1.

The XG candidates, and several EG4, 5, and 6 candidate genes along with the best candidates from the previous round of assays for EG4, 5, and 6 were used in a PHW assay (FIG. 11). The results indicate that several of the enzymes have activity on PHW. The EG4s from C. globosum and T. terrestris both gave an increase in glucose release relative to the negative control and relative to the strain expressing T. reesei EG2. The same was true for the C. globosum EG5, and the N. crassa EG6. The XG candidates showed only a very minor increase in reaction over the control strain, with the N. fischerii XG appearing to be the best.

Example 3

Cloning and Expression of 5 Synthetic Xylanases and 5 Synthetic Xylosidases in S. cerevisiae Xylanases and xylosidases were examined for expression in yeast in order to broaden the enzymatic activity spectrum of the yeast made lignocellulolytic system. Xylanases were selected from the public databases and their functional expression in yeast was tested on substituted xylans. Xylosidases were selected based on homology to A. niger xlnD (a GH family 3 enzyme) and to include xylosidases from GH family 43. Table 5 (condensed version of Table 4) indicates the genes chosen for synthesis as well as the designation of the expression vector. All the genes were cloned under control of the ENO1 promoter/terminator using the pMU1531 expression plasmid. The plasmids were all transformed to S. cerevisiae M0509 and transformants were confirmed with PCR.

TABLE 5

Xylanase and xylosidase encoding genes expressed in S. cerevisiae.

| Organism & Gene: | GH Family: | Expression plasmid: | Theoretical size (kDaa) |
|---|---|---|---|
| Xylanases: | | | |
| T. reesei xyn2 (native sequence) | 11 | pRDH182 | 21.0 |
| T. reesei xyn2 (synthetic) | 11 | pRDH169 | 21.0 |
| Chaetomium thermophilum xyn11A | 11 | pRDH170 | 27.8 |
| Aureobasidium pullulans var. melanigenum xyn10 | 10 | pRDH171 | 39.9 |
| Cryptococcus albidus xylanase | 10 | pRDH172 | 35.8 |
| Aspergillus niger xylanase D | 43 | pRDH174 | 35.4 |
| Xylosidases: | | | |
| Aspergillus niger xlnD - native sequence (S.c.MFα secretion signal) | 3 | pRDH181 | 86.7 |
| Cochliobolus carbonum β-xylosidase | 43 | pRDH175 | 36.8 |
| Penicillium herquei xylosidase | 43 | pRDH176 | 37.4 |
| Pyrenophora tritici-repentis β-xylosidase | 43 | pRDH177 | 36.9 |
| Aspergillus nidulans xylosidase | 3 | pRDH179 | 87.1 |

Figure 12:
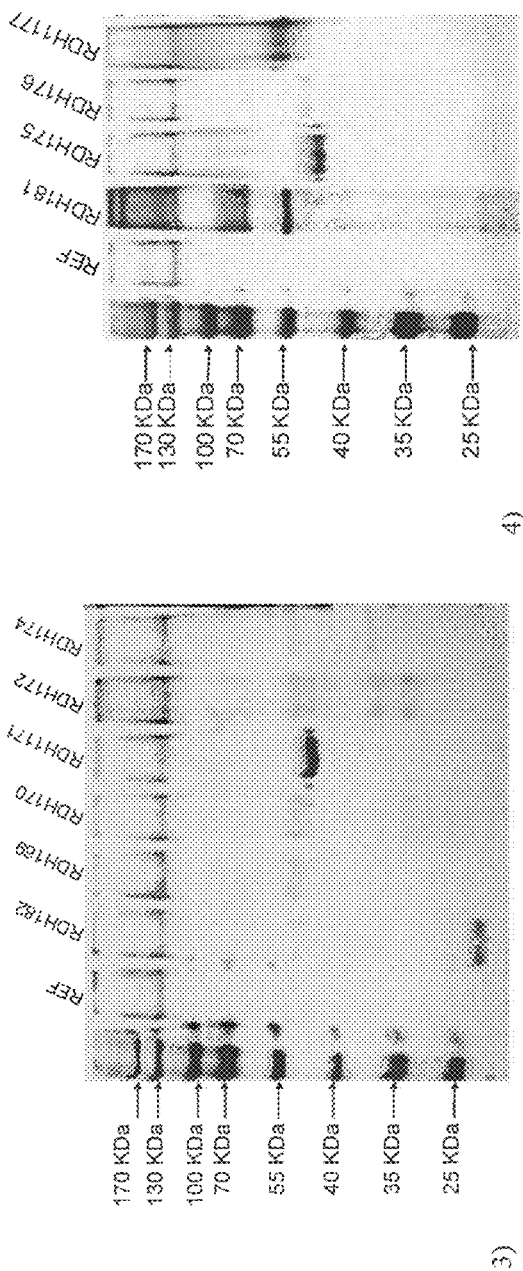
FIG. 12 depicts results of a SDS-PAGE analysis of the supernatants of (A) xylanase and (B) xylosidase producing strains. A strain containing a plasmid with no foreign gene was used as reference strain (REF). The strain containing the plasmid pRDH182 (expressing T.r.xyn2) or containing the plasmid pRDH181 (expressing A.n.xlnD) was also included.

Along with the reference strain (containing pMU1531), a strain expressing the native sequence of T.r.xyn2 (pRDH182) and a strain expressing the native sequence of A.n.xlnD (pRDH181), the xylanase/xylosidase expressing strains were tested for activity on 1% birchwood glucuronoxylan (Roth) and pNP-xylopyranoside (pNPX). The strains were grown in YPD or buffered double strength SC medium (pH 6). Zeocin was added to a final concentration of 100 µg/mL for liquid cultures. 10 mL Cultures in 125 mL Erlenmeyer flasks were incubated at 30° C. for three days (YPD) or four days (SC). Three flasks were inoculated for each strain. After incubation, samples were taken for gel analysis, protein determination and activity measurement. After centrifugation of the samples, 12 µL of each was taken, added to 5 µL of protein loading buffer and boiled for 5 minutes. The samples were subsequently loaded on a 10% SDS-PAGE and separated, followed by silver staining (FIG. 12).

Figure 14A:
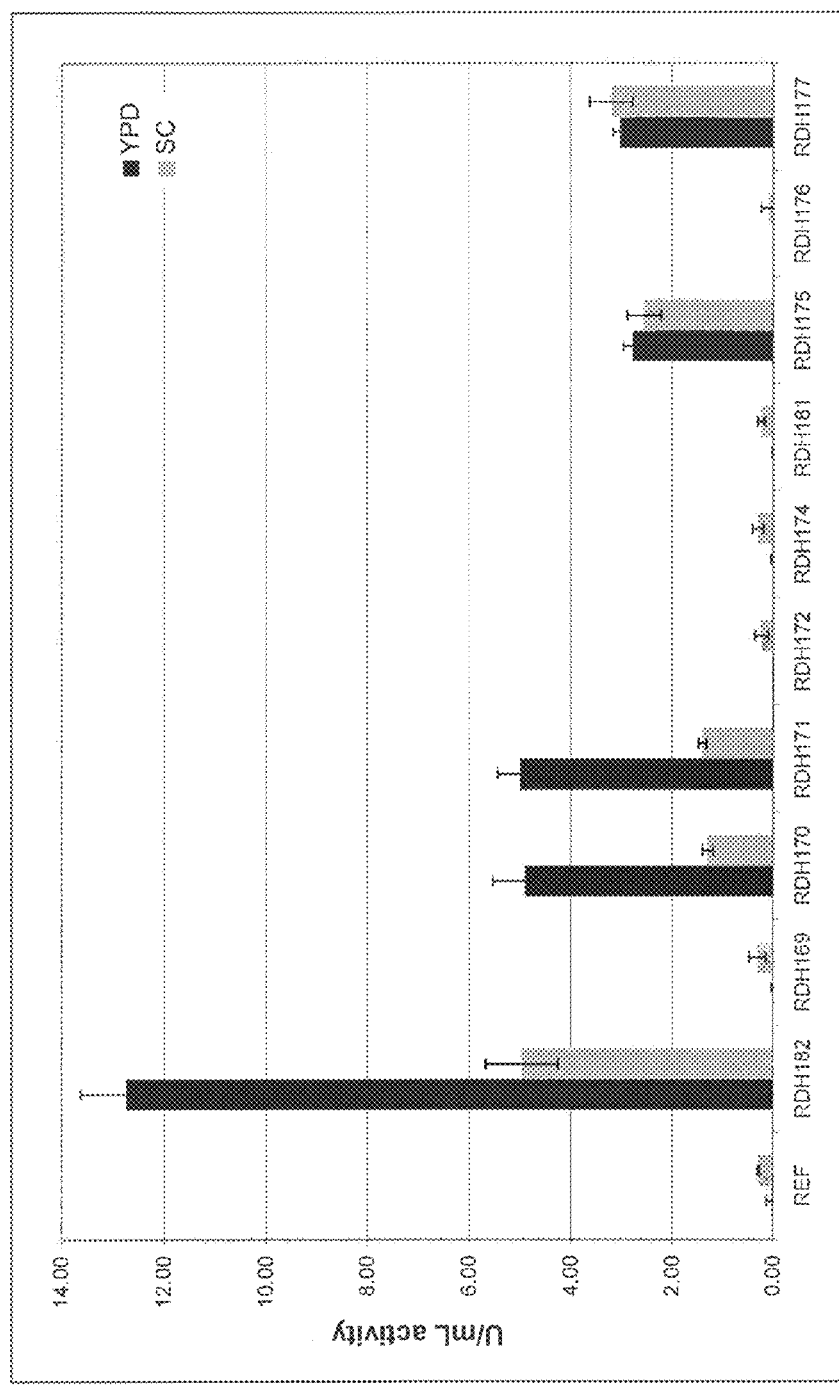
FIG. 14A and FIG. 14B depict results of an assay measuring activity of YPD and SC cultured strains expressing xylanases and xylosidases on 1% birchwood glucuronoxylan (A) and pNPX (B). A strain containing a plasmid with no foreign gene was used as reference strain (REF).
Figure 14B:
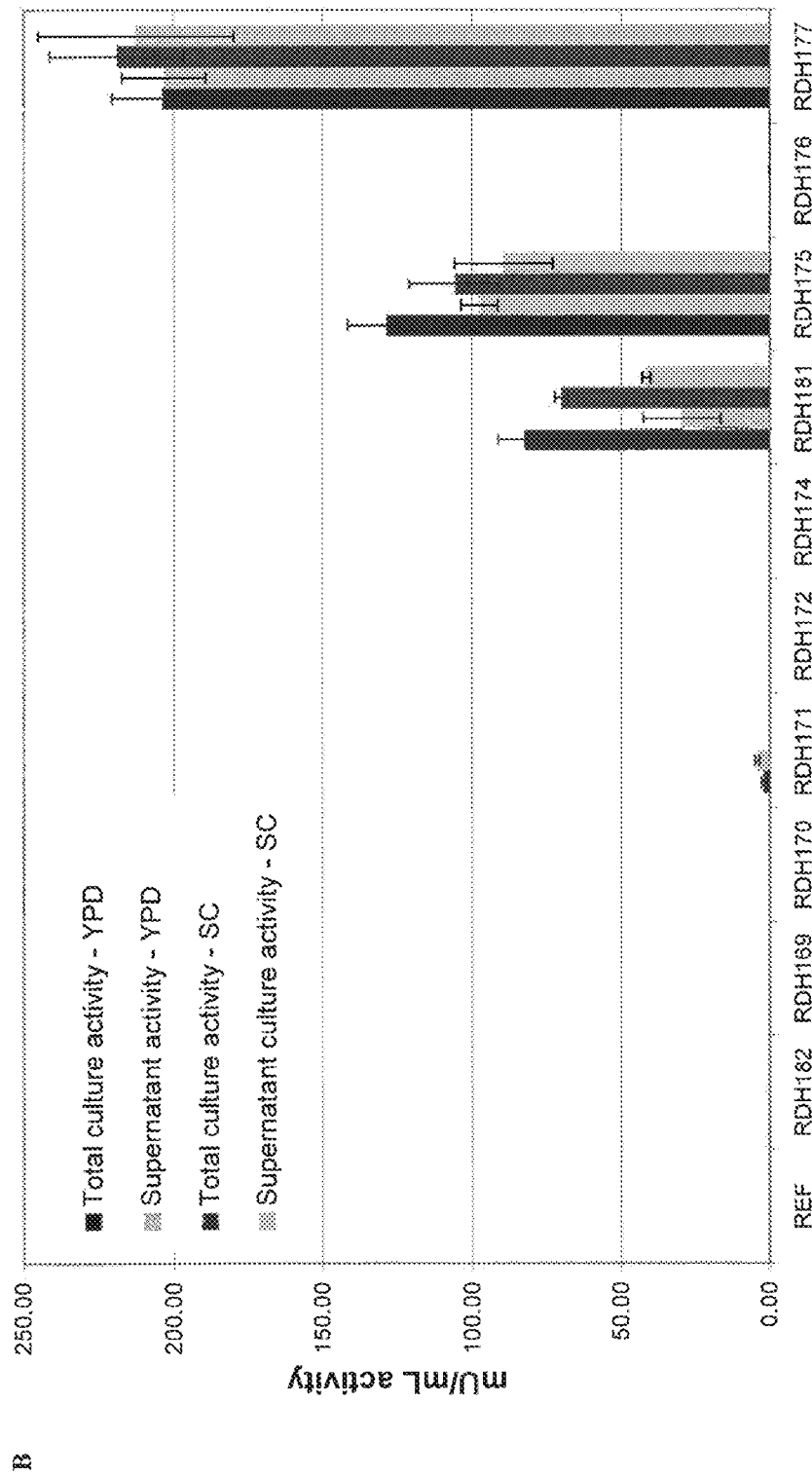

From the gel it appeared that not all strains produced a visible band in the expected size range (see Table 5 for predicted sizes). (A) The T.r.XYN2 appeared as a band of about 21 kDa as predicted. The *Chaetomium thermophilum* XYN11A is visible as a faint band of about 36 kDa, larger than the expected 27.8 kDa. The *Aureobasidium pullulans* XYN10 is visible as a prominent band at ~50 kDa. The *Cryptococcus albidus* and *Aspergillus niger* xylanases are also visible as bands slightly larger than predicted but these gene products yielded no activity in liquid assays (FIG. 14). The increased sizes of the secreted enzymes can likely be explained as a result of hyperglycosylation. (B) A large smear at >90 kDa may represent heterogeneously glycosylated forms of the *A. niger* XLND xylosidase. The *Cochliobolus carbonum*, *Penicillium herquei*, and *Pyrenophora tritici-repentis* xylosidases are present as 45, 50 and 55 kDa bands (slightly smeared), larger than the predicted ~37 kDa also indicating likely hyperglycosylation.

Figure 13:
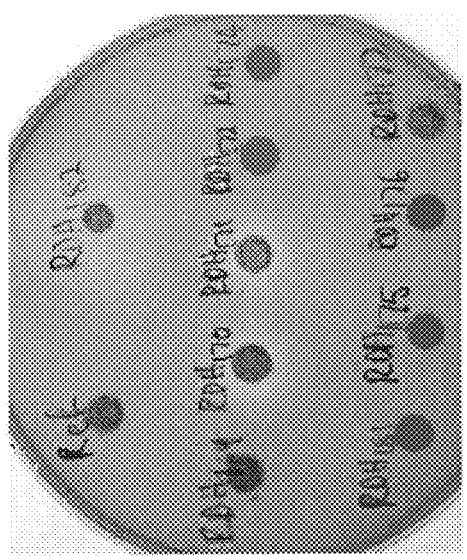
FIG. 13 depicts the results of a RBB-xylan assay. Cultures were spotted on $SC^{-URA}$ plates containing 0.2% RBB-xylan. Numbers indicate the plasmid contained by each strain. Plates were incubated for 24 hours at 30° C.

To screen for xylanase activity, 5 µL of the cultures used for quantitative assays were spotted on an $SC^{-URA}$ plate containing 0.2% RBB-xylan and incubated for 24 hours (FIG. 13). As can be seen from the figure, the T.r.xyn2 expressing strain (RDH182) yielded a very good clearing zone whereas the reference strain did not. Of the other xylanase expressing strains *Chaetomium thermophilum* xyn11A and *Aureobasidium pullulans* xyn10 yielded clearing zones but none of the other strains produced a visible clearing zone.

All strains were tested for activity on birchwood glucuronoxylan (Roth) and pNP-xylopyranoside (pNPX). Xylanase assays were performed essentially as described in La Grange et al. (1996, *Appl. Environ. Microbiol.* 62, 1036-1044). Reactions were miniaturized for use in a 96-well PCR plate. 5 µL supernatant was added to 45 µL 1% glucuronoxylan and incubated at 35° C. for 5 minutes. Reactions were stopped by adding 75 µL DNS before heating at 99° C. for 5 minutes. A standard curve was set using xylose. Xylosidase assays were performed in the same manner as for β-glucosidase assays (see above protocol) but with pNPX as substrate at pH5, 35° C. for 2-5 minutes depending on the activity. Activity data from strains grown on YPD and SC can be seen in FIG. 14.

From the activity data it would appear that the strain expressing the native T.r.xyn2 (pRDH182) produced the highest levels of secreted xylanase activity. It was surprising that the strain containing a codon optimized version of this gene (sequence verified) displayed no secreted activity. The GH family 11 xylanase encoded by *Chaetomium thermophilum* xyn11A did give notable activity, however, far less than that generated by the strain expressing native T.r.xyn2. The strain expressing *Aureobasidium pullulans* xyn10 (GH family 10) also yielded appreciable activity. This is particularly encouraging as it is known that family 10 xylanases often have only 10% of the specific activity of GH family 11 enzymes. However, family 10 xylanases are less restricted in their action by side chain substitutions on the xylan backbone. Somewhat surprisingly, the GH family 43 xylosidases encoded by the genes from *Cochliobolus carbonum* and *Pyrenophora tritici-repentis* gave substantial xylanase activity. These enzymes are also classed as "exo-xylanases" and it will be very interesting to see how they interact with other xylan degrading enzymes. The strains producing these two enzymes also displayed far greater xylosidase activity on pNPX than the strain expressing native A.n.xlnD. Furthermore, the strain expressing native A.n.xlnD secreted only about 36% of the total xylanase activity it produced when grown in YPD whereas 76% and 99% of the *C. carbonum* and *P. tritici-repentis* heterologous xylosidases were secreted. The secreted xylosidase activities of the strains producing *C. carbonum* and *P. tritici-repentis* xylosidases in YPD were respectively 3.3 and 6.9 fold higher than the secreted activity of the strain expressing native A.n.xlnD.

Figure 15:
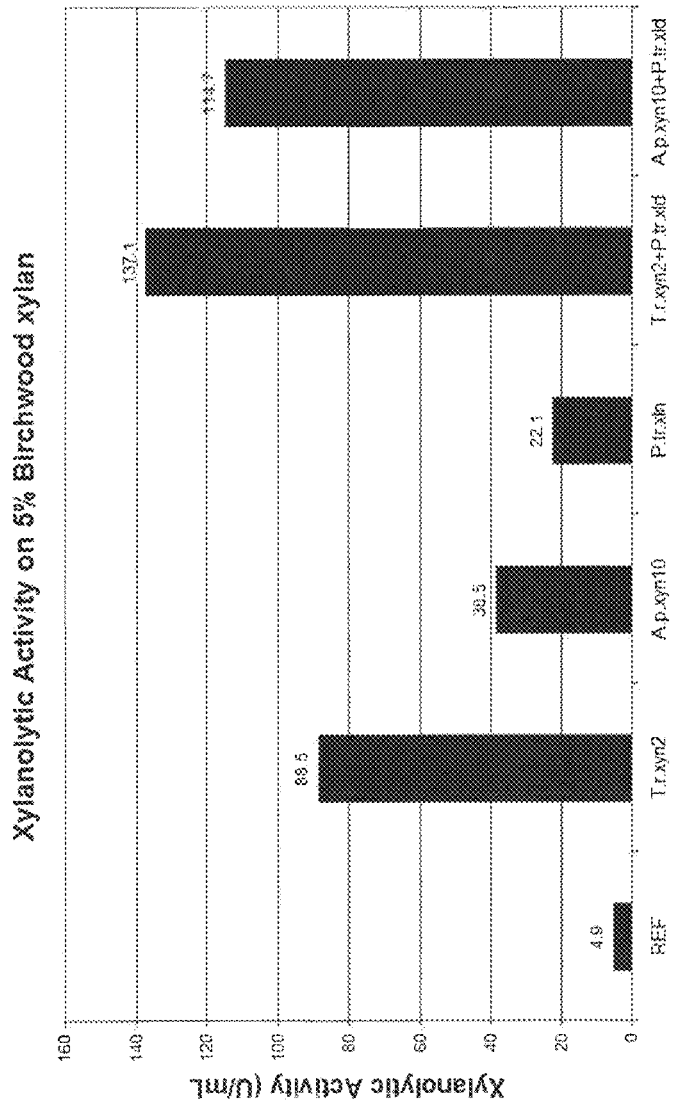
FIG. 15 depicts results from an assay measuring hydrolytic activity as measured by reducing sugar released by mixtures of yeast supernatants from 5% xylan.

An assay assessing synergy of the best xylanases and xylosidases identified is shown in FIG. 15. Birchwood glucuronoxylan (5% in 50 mM NaOAc, pH5) was prepared and 400 µL aliquots were placed in a deep well plate. Subsequently, supernatants of SC-grown yeast strains were added as follows:

1. 100 µl supernatant of REF strain
2. 50 µl supernatant of REF strain, 50 µl supernatant of RDH182 strain (T.r.xyn2)
3. 50 µl supernatant of REF strain, 50 µl supernatant of RDH171 strain (A.p.xyn10)
4. 50 µl supernatant of REF strain, 50 µl supernatant of RDH177 strain (P.tr.xld)
5. 50 µl supernatant of RDH182 strain (T.r.xyn2), 50 µl supernatant of RDH177 strain (P.r.xld)
6. 50 µl supernatant of RDH171 strain (A.p.xyn10), 50 µl supernatant of RDH177 strain (P.tr.xld)

Figure 16:
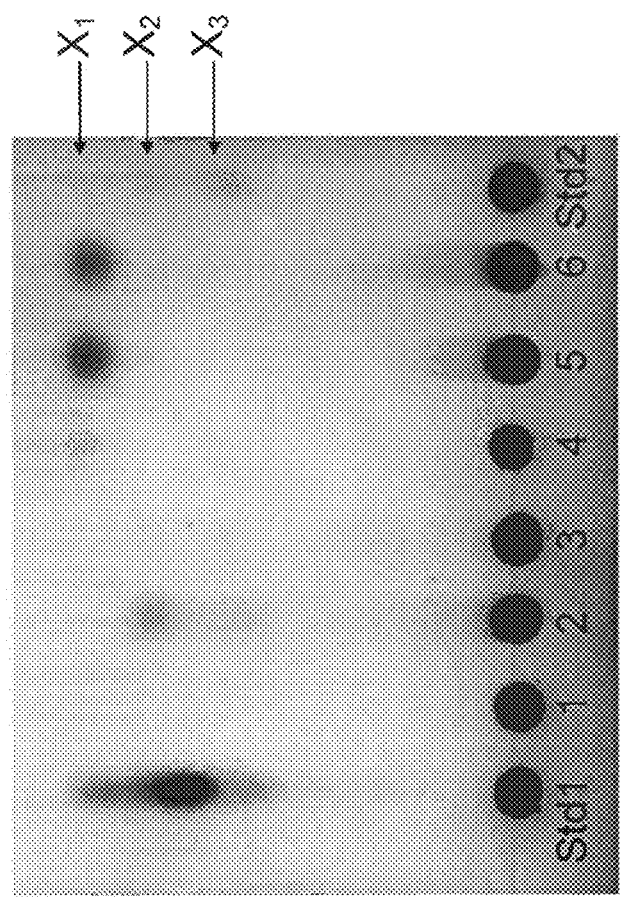
FIG. 16 depicts results of a TLC assay measuring sugars released by yeast supernatants from birchwood glucuronoxylan. Std1 contained xylotetrose, xylotriose, xylobiose and xylose: Std2 contained, xylotriose, xylobiose and xylose. 5 μL of reactions 1 to 6 were loaded.

The mixtures were shaken on a microtiter plate shaker at 1000 rpm, 35° C. for 22 hours. DNS assays were performed to ascertain the amounts of reducing sugar formed (FIG. 15). From this result it would seem that there was a synergistic effect when the xylanases and the xylosidase were mixed. The activity of the T.r.XYN2 and P.tr.XLD mix was 1.24 times more than the sum of the activities separately. The activity of the A.p.XYN10 and P.tr.XLD mix was 1.9 times more than the sum of the activities of those supernatants separately. To analyze the released sugars, 5 µL of each reaction and standards were spotted on a silica coated thin layer chromatography (TLC) plate and separated with and eluant consisting of isopropanol:ethanol:water (7:1:2). The plate was then developed by dipping it in a mixture of 5% $H_2SO_4$ (made in ethanol) and heating in a 180° C. oven (FIG. 16). The action of the xylanases (lanes 2 and 3) yielded small amounts of xylotriose and more significant amounts of xylobiose. The xylosidase from *P. tritici-repentis* released a small amount of xylose from xylan (lane 4). Mixtures of the heterologously produced xylanases with the xylosidase yielded significant amounts of xylose (lanes 5 and 6) with no visible xylo-oligos remaining in these reactions. These reactions will be further analysed with HPLC analysis. The results presented in FIGS. 15 and 16 show that the promising xylanases and xylosidases identified in this study can synergise and yield the desired product namely xylose.

Figure 39:
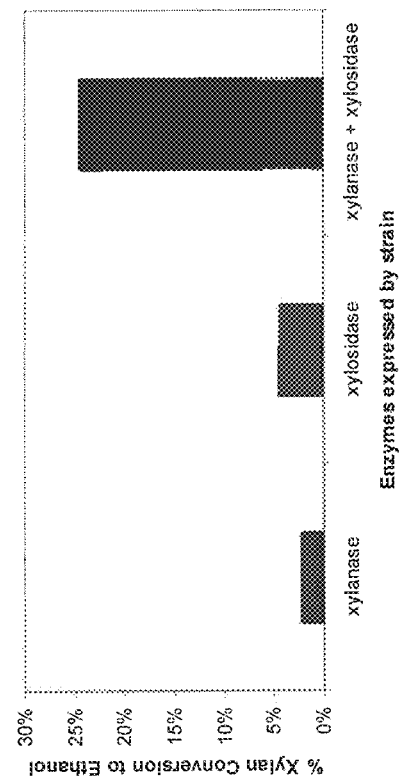
FIG. 39 depicts conversion of xylan to ethanol by several strains of *S. cerevisiae* expressing xylanase alone, xylosidase alone, or a combination of the two enzymes.
Figure 40:
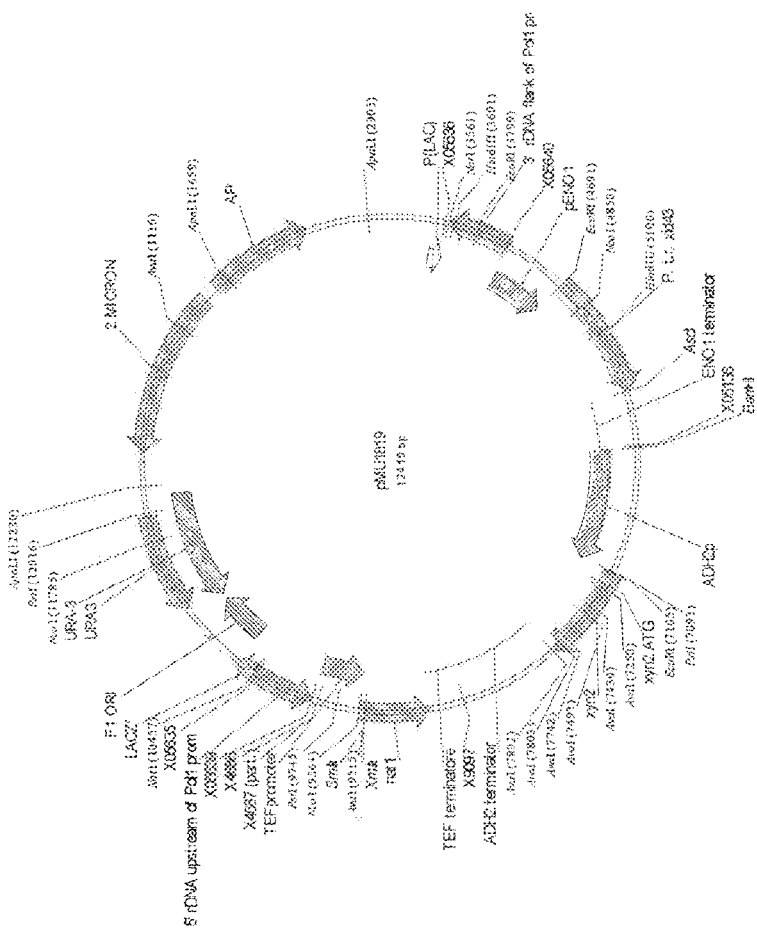
FIG. 40 depicts a genetic construct used to co-express xylanase and xylosidase via integration at the rDNA loci.

Derivatives of M0509 expressing the *T. reesei* Xyn2 (xylanase, pRDH182), and the P.t.r. GH43 xylosidase (xylosidase, pRDH177), or both the enzymes (pMU1819 below) were created. A cassette to integrate both enzymes was created so that both enzymes could be integrated at the rDNA locus. (FIG. 40). Selection was carried out via the natMX marker. The ability of the three strains to utilize xylan was tested by cultivating them in media containing yeast extract (1%), peptone (2%), glucose (2%), and xylan (5%). For each strain the percentage of the xylan that could be converted to ethanol in this test is shown in FIG. 39. The results demonstrate the synergy between the two enzymes as well as the ability to create a strain that can directly convert xylan to ethanol.

Example 4

Screening of Fungal Accessory Enzymes

Assays for arabinofuranosidase activity and esterase activity were carried out to assess whether any of the accessory enzymes were functional. The arabinofuranosidase assay was carried out as follows: Substrate (1 mM 4-nitrophenyl-L- arabinofuranoside (Sigma #N-3641)) was made up in 50 mM citrate buffer pH 5.4 and preheated to 35 C. 20 ul of yeast supernatant plus 180 ul of substrate was added to 96 well plate, and incubated at 35 degrees for 30 minutes. The reaction was stopped by adding 100 ul of 1M $Na_2CO_3$ and an OD measurement was taken at 405 nM. Zoomerase (1 ul) at a concentration of 177 ug/ul was added in a total of 20 ul citrate buffer. The esterase activity assay was carried out as follows: A 200 mM stock of substrate (4-Nitrophenol Acetate-Sigma N-8130) was made up in DMSO; 50 ul of this stock was added to 10 mls of citrate buffer pH 5.4 to make a 1 mM final concentration. 50 ul of supernatant to be tested was added to a 96 well flat bottom plate plus 100 ul of substrate solution. The reaction was incubated at 35 degrees for 30 minutes and the OD at 410 nm was taken.

Figure 17:
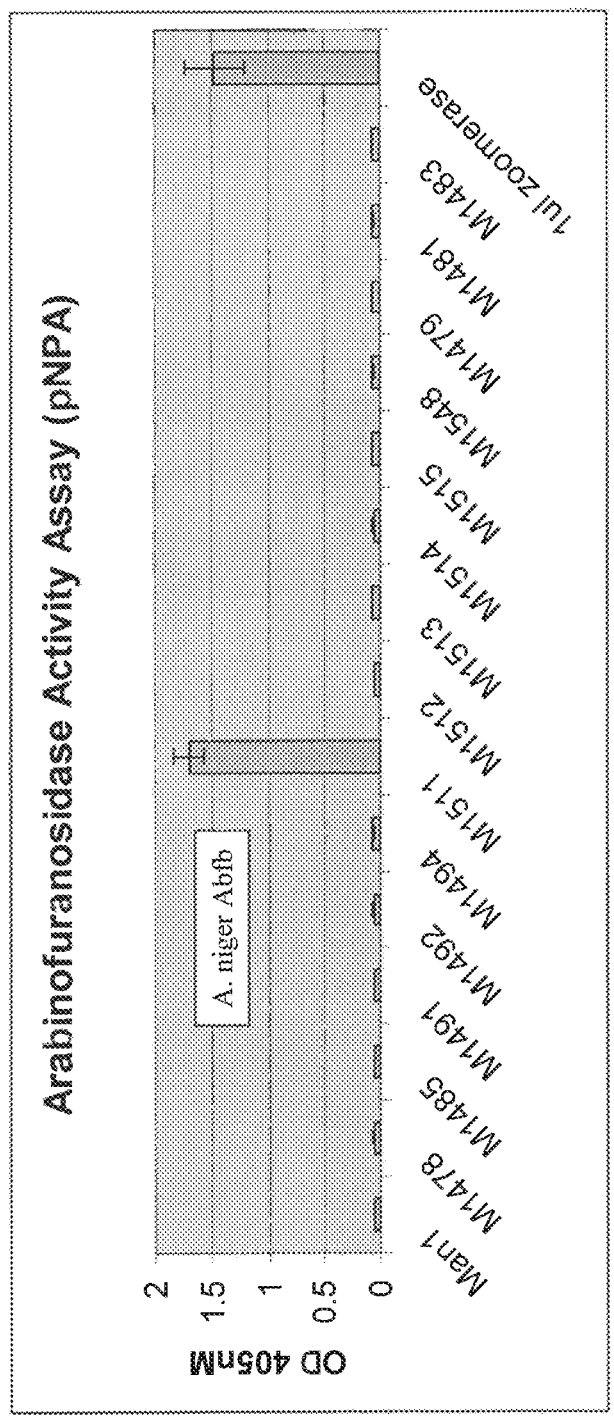
FIG. 17 depicts results of an arabinofuranosidase activity assay with pNPA as substrate.
Figure 18:
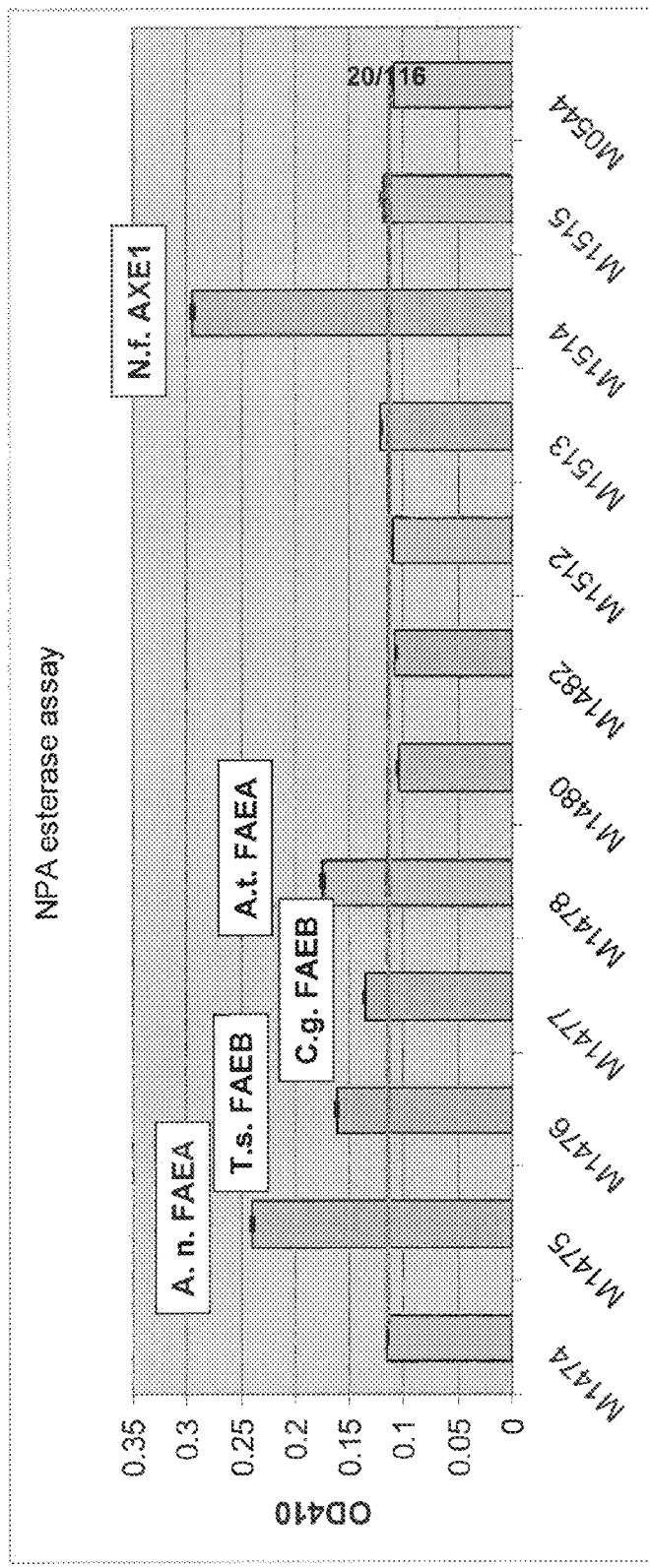
FIG. 18 depicts results of an esterase activity of candidate enzymes on pNP-acetate.

FIGS. 17 and 18 show the results for the assays that were carried out. Only the Abfb gene from *A. niger* showed activity on the synthetic substrate pNPA. This confirms expression of this gene, which has been previously expressed in yeast (Crous et al. 1996), in our strain. The GH62 arabinofuranosidase candidates did not show activity on this substrate, which could be due to poor expression, or an inability to cleave the substrate. Several genes were shown to have activity on the synthetic substrate p-Nitrophenol-actetate (FIG. 18). Candidates for both types of feruoyl esterases (FAEA and FAEB), as well as one of the acetyl xylan esterases (AXE) were shown to be active.

Figure 19A:
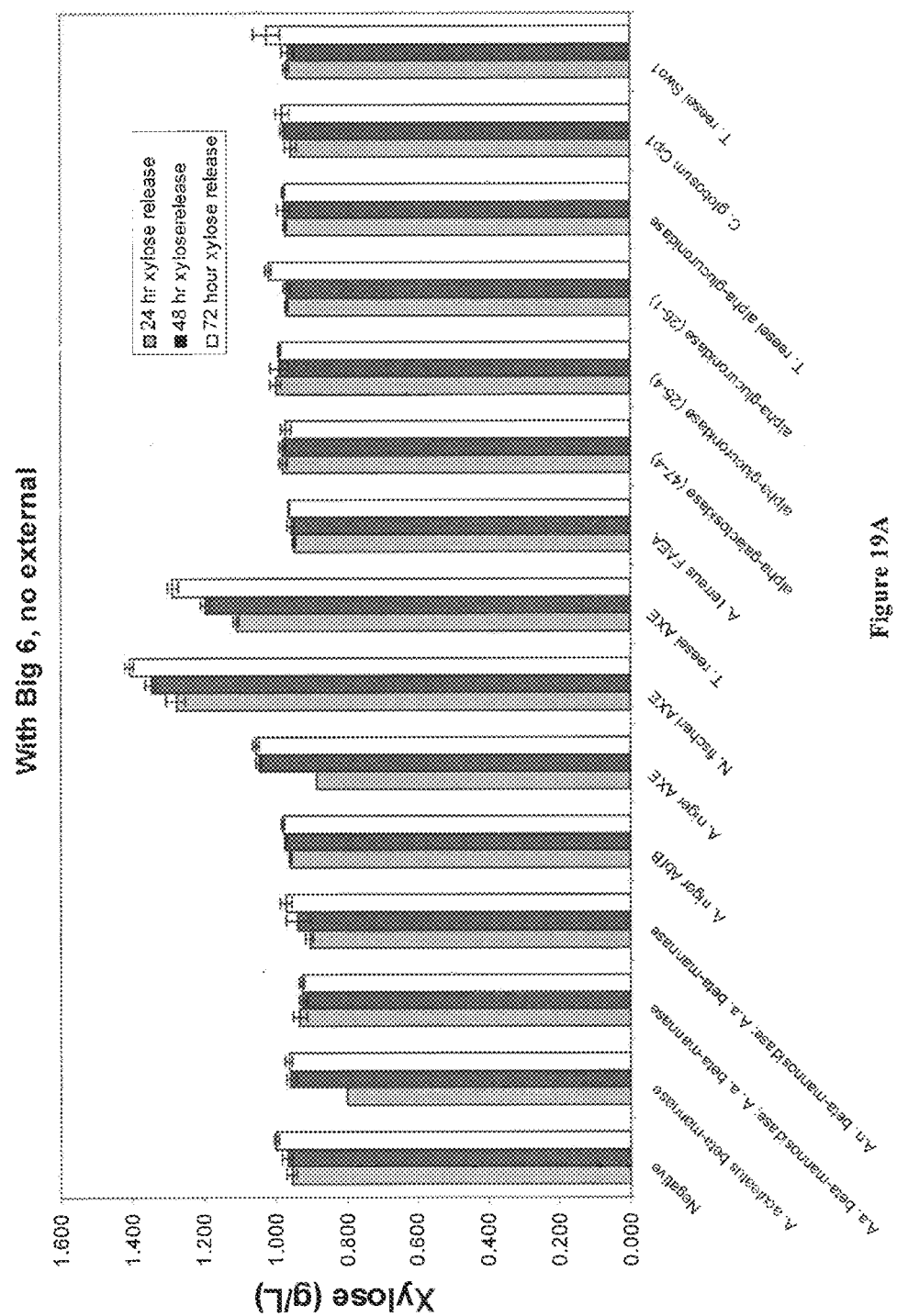
FIG. 19A and FIG. 19B depict results in a PHW assay on unwashed MS630 for various accessory enzymes. Cultures were grown for 3 days at 35 degrees in 10 mls YPD with 20 ug/ml zeocin in 50 ml conical tubes. 1 ml of supernatant was added for each candidate, 0.5 ml each of M1457 (BC60 xylanase) and M1381 (P.t.r. GH43 xylosidase) plus 2 mls of PHW core mix. Core enzymes added were 1 mg/g of purified CBH1/CBH2/EG2 and 0.2 mg/g of BGL1.
Figure 19B:
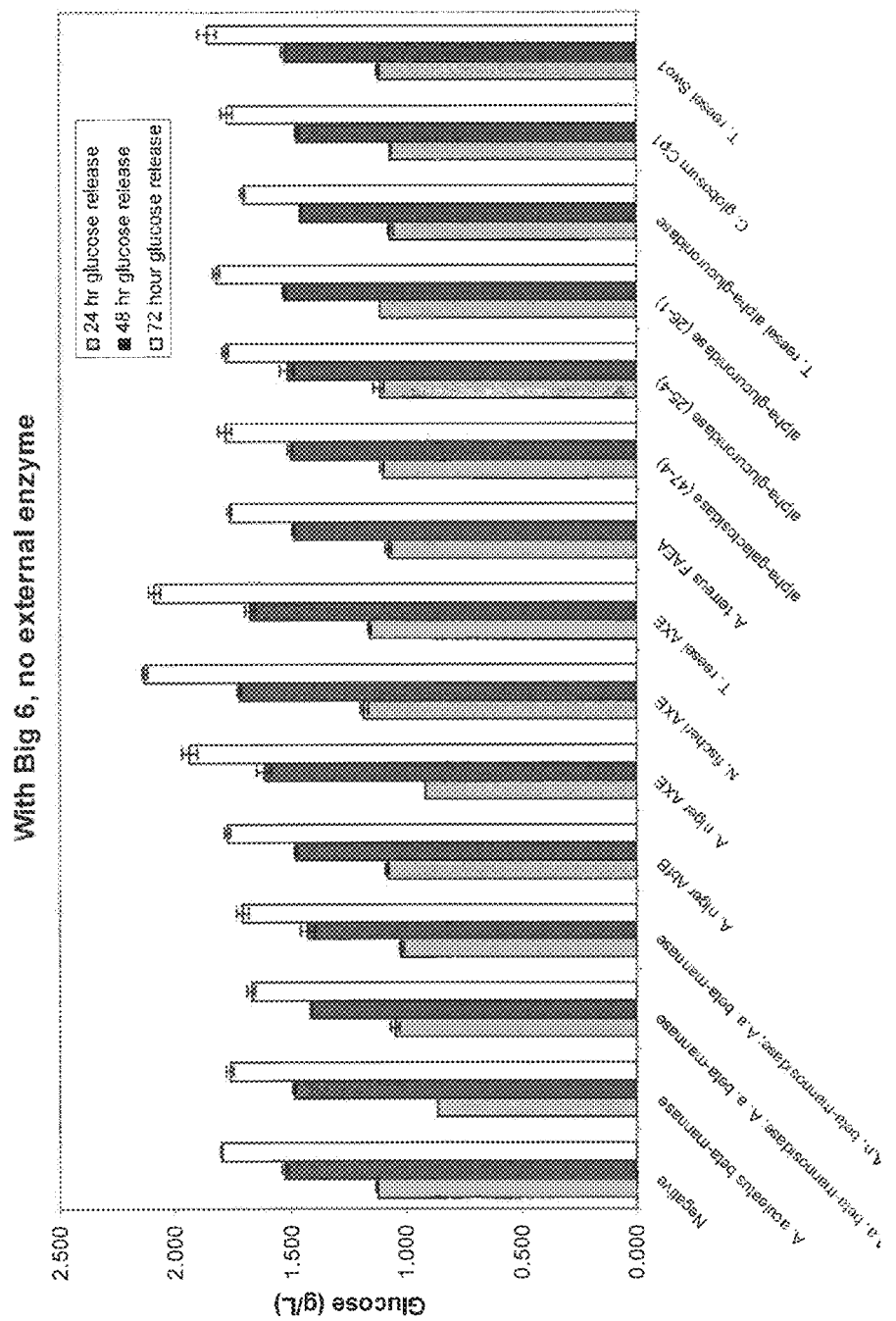

PHW assays were set up to screen several accessory components and assess their impact in the presence of other yeast made enzymes. FIG. 19 shows the results of the first screen, which demonstrate that both the *Neosartorya fischeri* and the *Trichoderma reesei* AXE genes expressed in M0544 yield increased xylan and glucan hydrolysis from unwashed pretreated hardwood substrate (MS630). In fact, without the AXEs present, there is no measurable release of xylose from this substrate using the yeast made xylanase and xylosidase. The hydrolysis of the xylan in MS630 should result in ~1.8 g/L xylose release in this assay, thus the ~1.4 g/L observed is about 77% of the total available, an increase of 25% over the control. Glucose hydrolysis was increased by ~25% by the presence of the N.f. AXE.

Figure 20A:
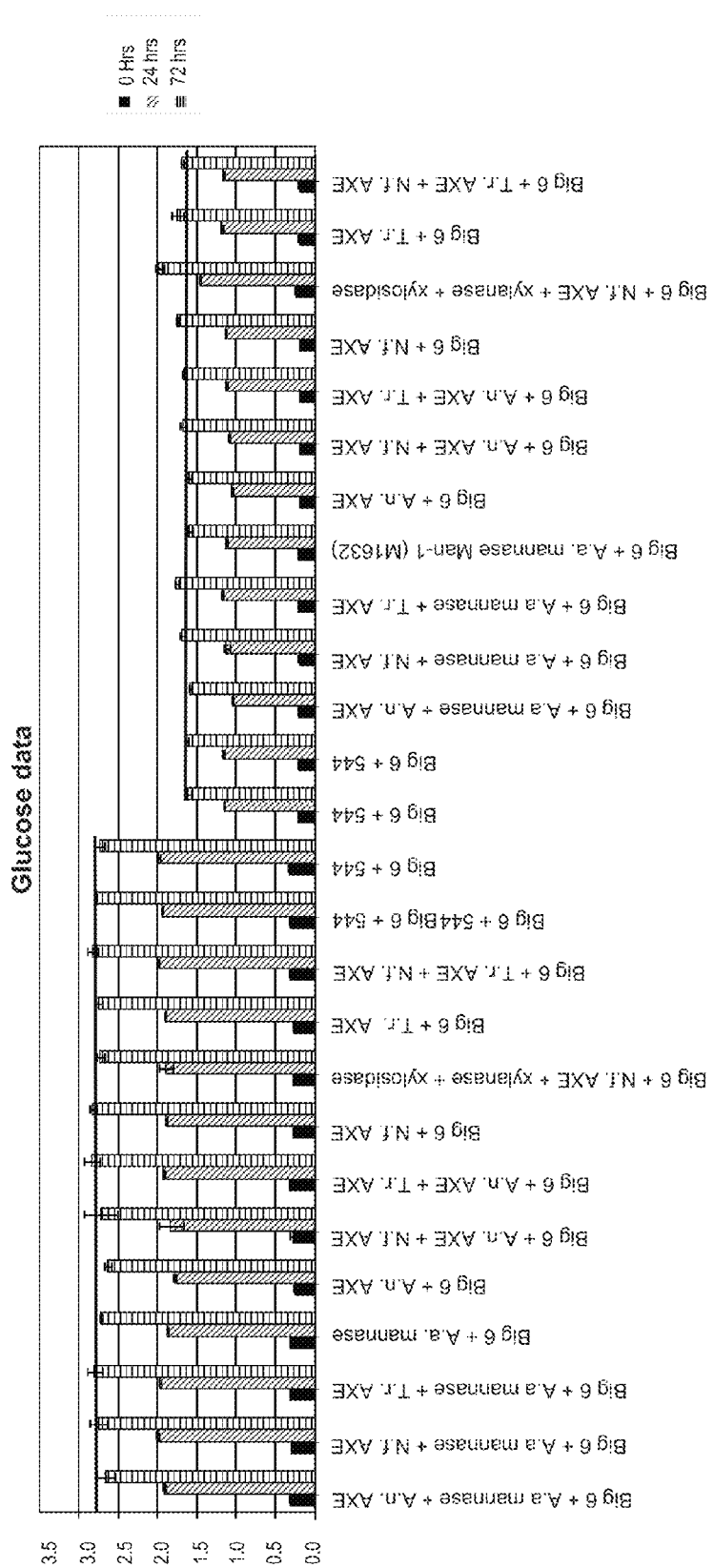
FIG. 20A, FIG. 20B and FIG. 20C depict results of a PHW assay using combinations of accessory enzymes on unwashed MS630 (hardwood substrait). So called "Big 6" enzymes were: 1 mg/g of purified CBH1 and CBH2, 0.4 mg/g purified EG2, and 0.2 mg/g purified BGL, 0.5 mL of each of M1457 (GH10 xylanase from *C. phytofermentens*, or BC60—see bacterial enzyme screening below) and M1381 (P.t.r. GH43 xylosidase). These were combined with PHW and buffer in a total volume of 2 mL and 2 mL of additional enzymes were added as tests, split evenly between the enzymes (i.e. 1 mL each of 2 enzymes, or 0.67 mL each of 3 enzymes, etc). Results for glucose and xylose liberated are depicted in panels A and B respectively.
Figure 20B:
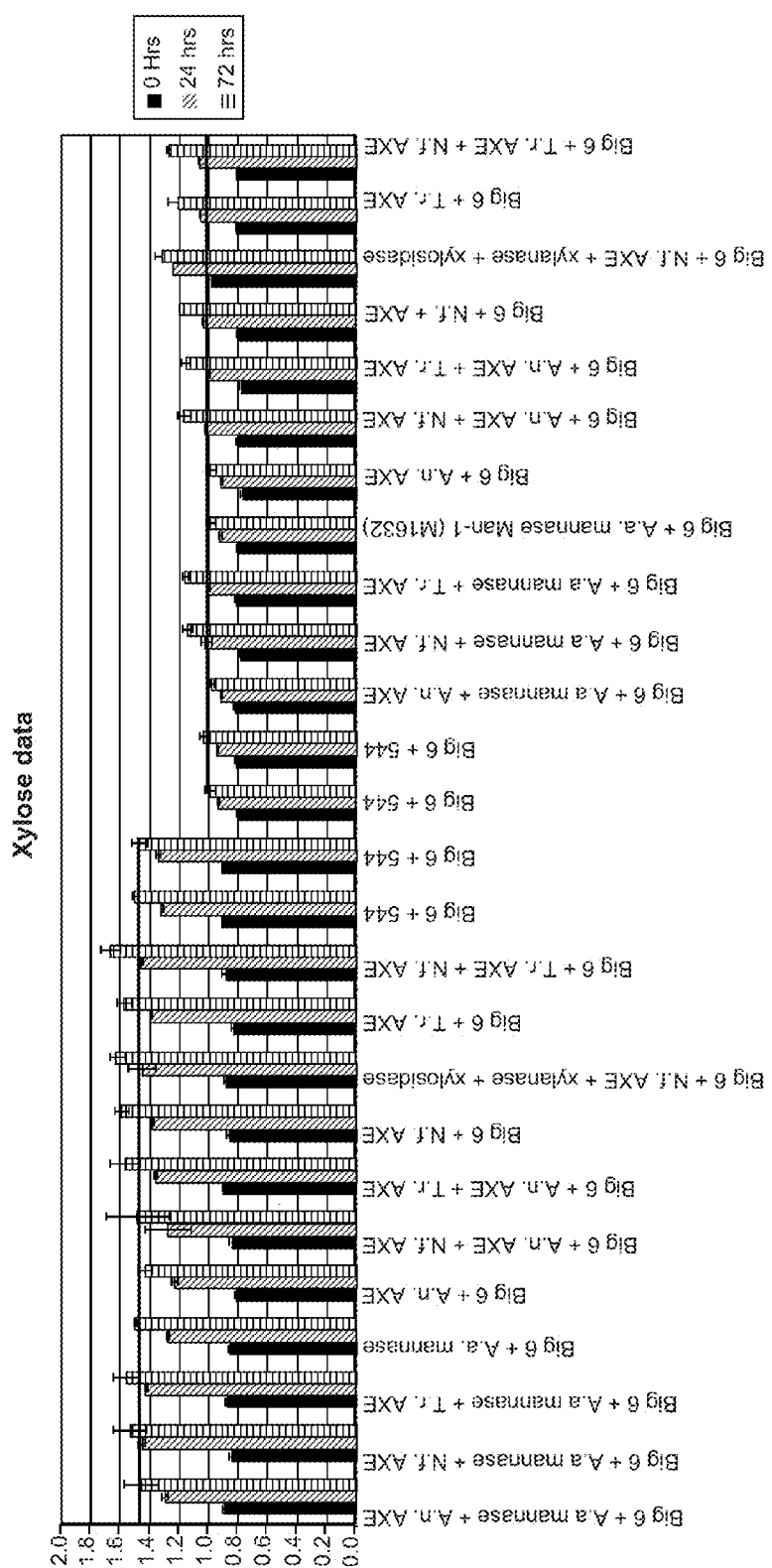
Figure 20:
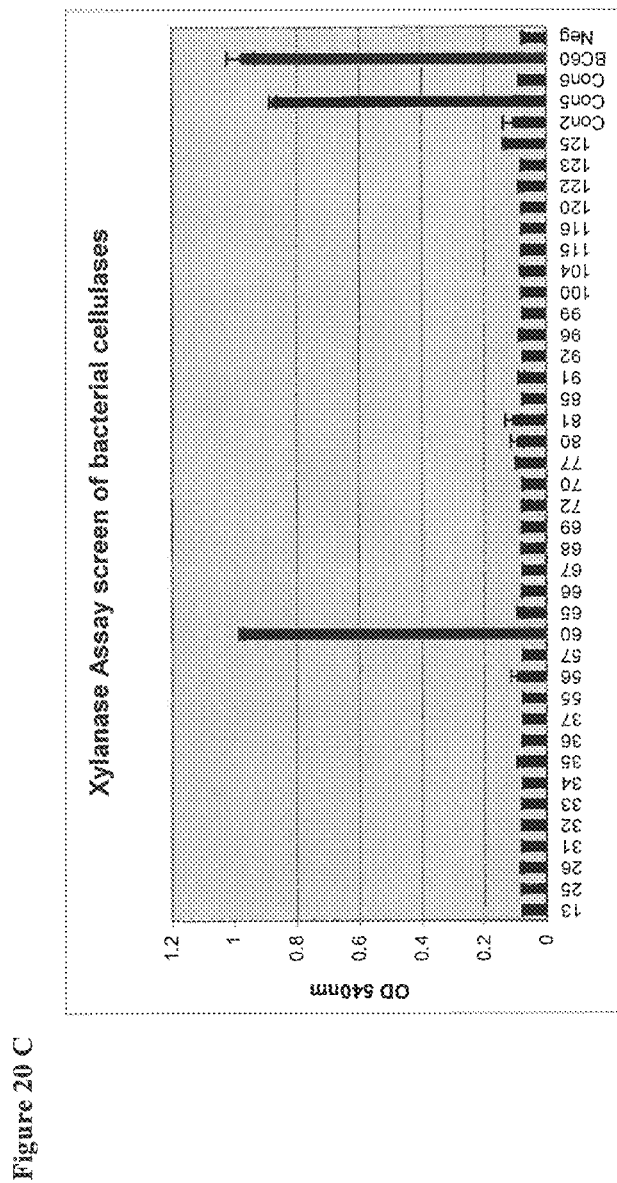

FIG. 20 shows the results of attempting combinations of enzymes on unwashed MS630 (a pretreated hardwood substrate). A couple of interesting results can be observed. One is that in the presence of zoomerase (1 mg/g) the accessories are having only a small impact on hydrolysis glucan in MS630 at the loadings tested. However, xylan hydrolysis is substantially increased by the presence either the N.f. AXE (acetylxylanesterase) or the T.r. AXE, with the best combinations yielding ~90% conversion. In the absence of zoomerase these enzymes increased the hydrolysis of both glucan and xylan. Additionally, reducing the amount of AXE and simultaneously increasing the loading of yeast made xylanase and xylosidase increased the rate of xylose release, indicating that these enzymes are the rate limiting ones needed at higher expression levels. The best combination of enzymes without zoomerase yielded ~72% conversion of the xylan to xylose.

Example 5

Testing Endoglucanases for Possible Xylanase Activity

It was shown previously that fungal and bacterial xylanases of GH10 and GH11 produce ethylxylanopyranoside (EXP) during fermentation. In order to find xylanases that do not produce EXP several fungal and bacterial enzymes belonging to different GH families were tested for xylanase activity. Enzymes from GH families 5, 7, 8, 10, 11, 12, 16, 26, 43, 44, and 51 were screened for activity on xylan as members of these families have been reported to contain some xylanase activity. Cultures were grown in YPD for 72 h and the supernatants were evaluated on the birchwood xylanase assay (FIG. 21).

Figure 21:
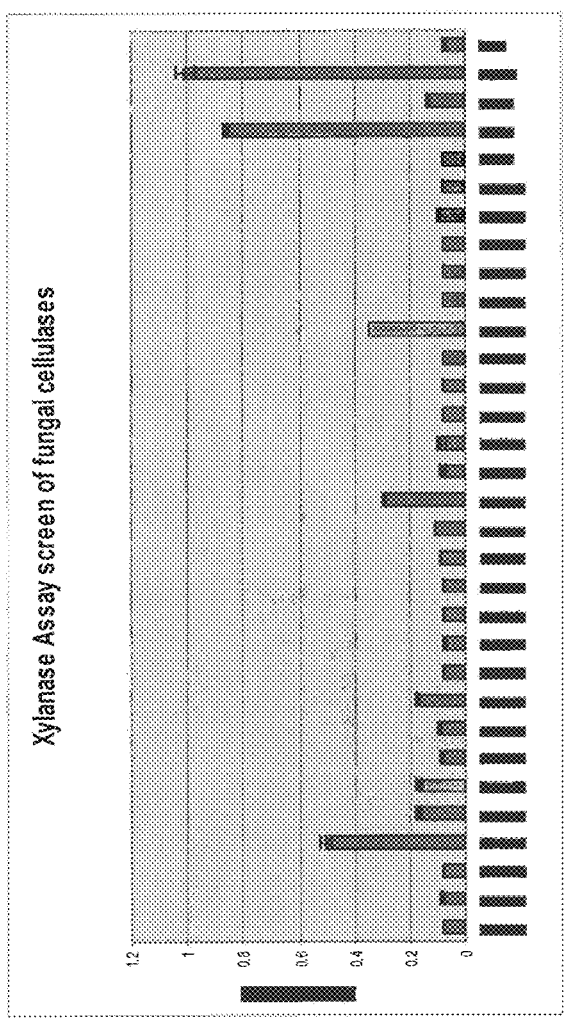
FIG. 21 depicts results from a xylanase assay of yeast strains expressing bacterial (top) and fungal (bottom) enzymes. On the top graph the numbers mean BC numbers described in Table 7.
Figure 22A:
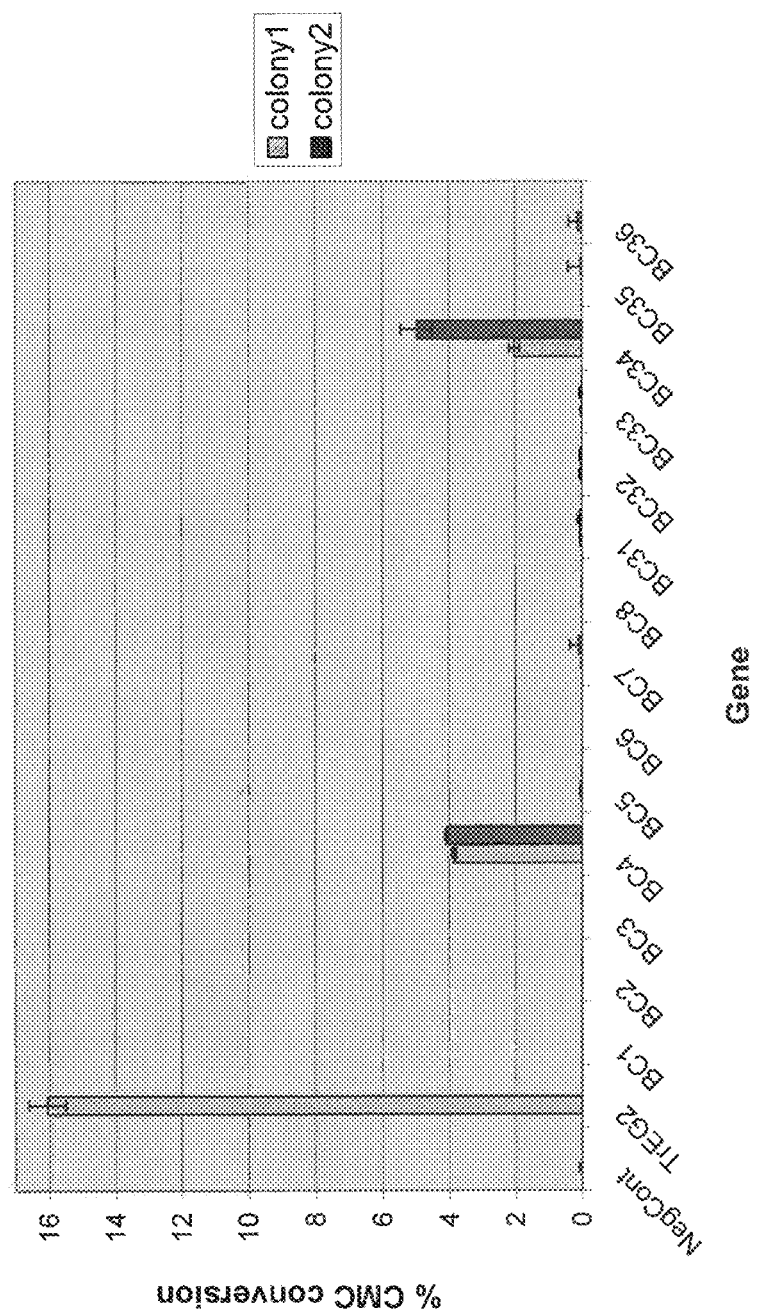
FIG. 22A, FIG. 22B, FIG. 22C and FIG. 22D depict results from an assay evaluating the secreted activity on CMC of bacterial endoglucanases expressed in yeast. Strains were patched on YPD+Zeo plates (Zeo 250 mg/L) for 2 days and inoculated in 600 uL YPD in 96 wp, and grown for 3 days at 35° C. at 900 rpm. The standard CMC assay was performed on supernatants. All strains have M0749 background. The negative control is M0749 transformed with empty expression vector pMU1575. *T. reesei* EG2 in pMU1575 was used as positive control construct.
Figure 22B:
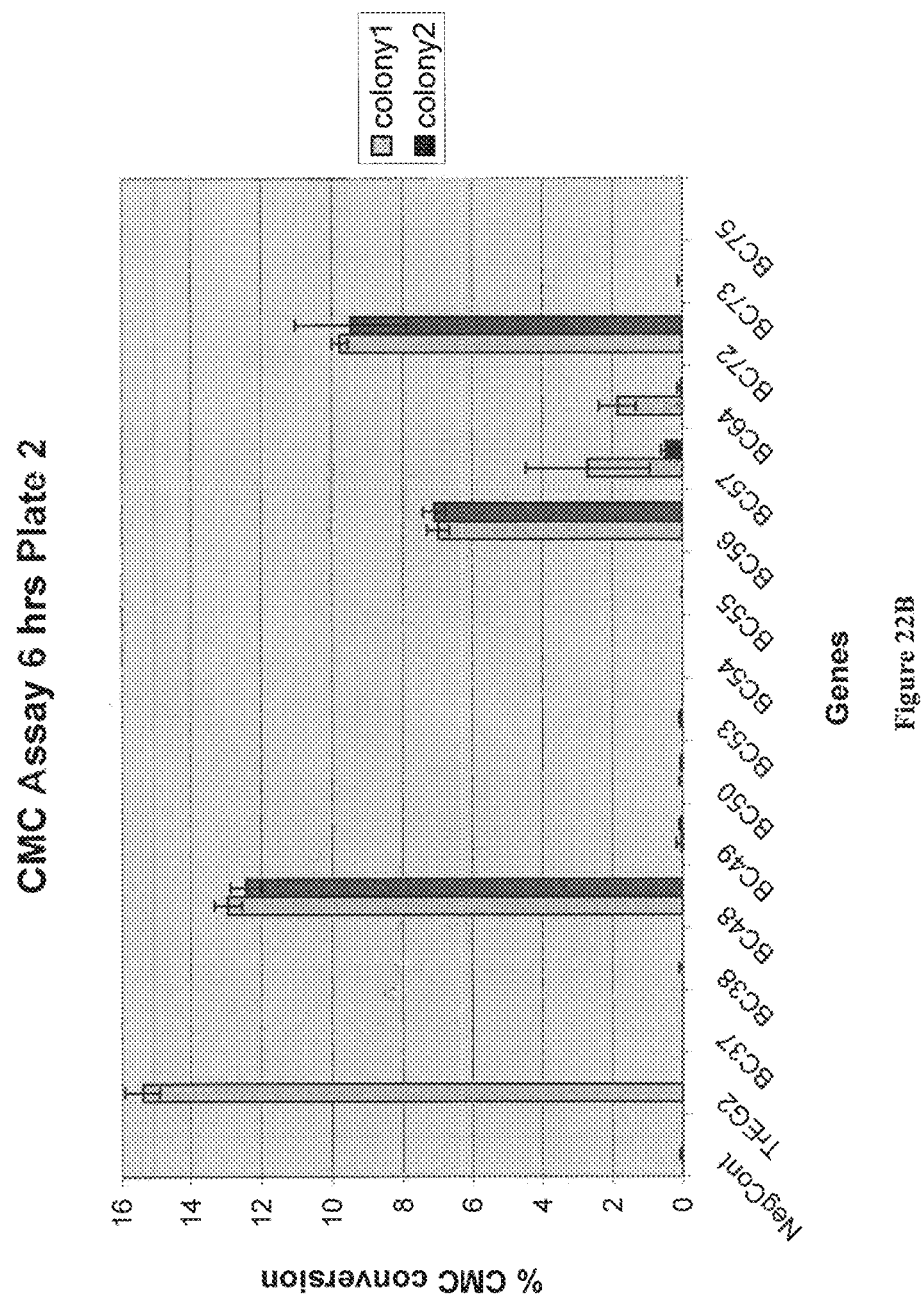
Figure 22C:
Figure 22D:
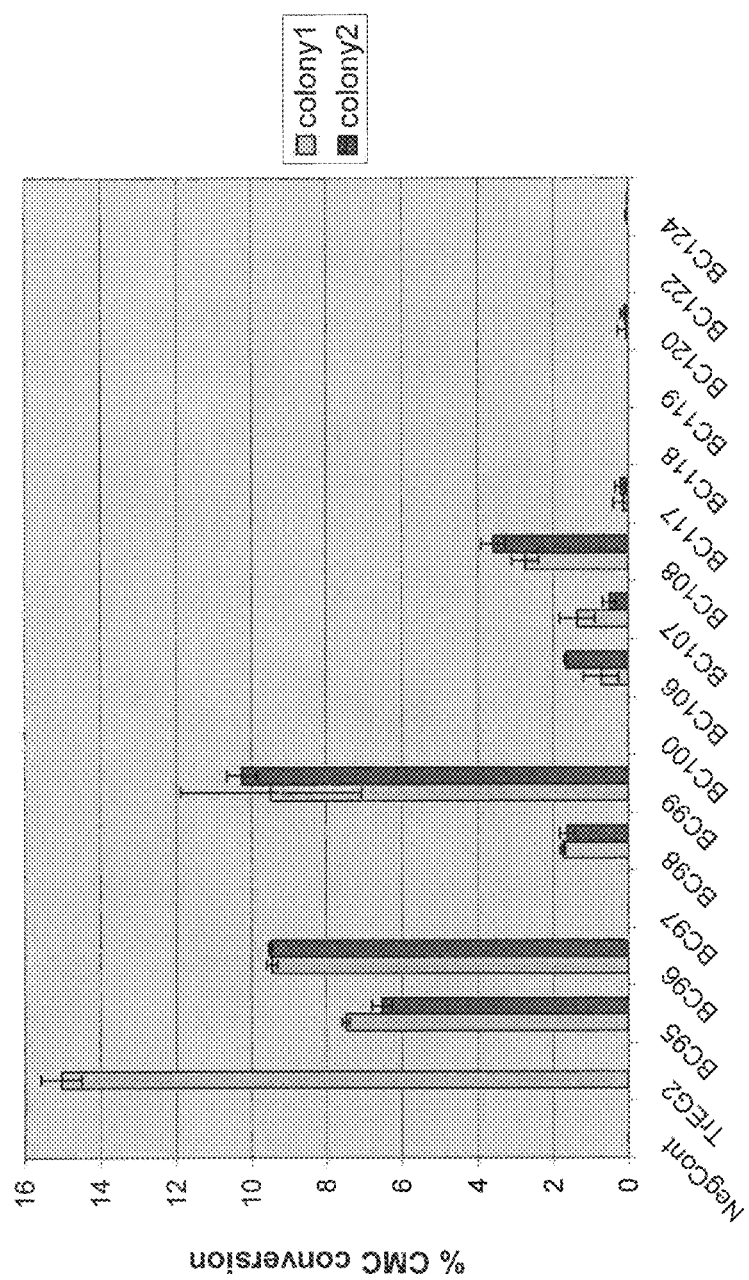

FIG. 21 demonstrates that BC 60 displayed significant xylanase activity, and also, the strains containing a fungal GH10 xylanase from *A. pullulans* (M1379), and two GH7 EG1's from *Aspergillus fumigatus* (M1311) and *Trichoderma longibrachiatum* (M1317) did have activity on birchwood xylan, although it was less than BC60 and *T. reesei* xyn2 (Con5).

Example 6

Expression of Bacterial Lignocellulolytic Enzyme System Components in Yeast

Several potential bacterial donors of lignocellulolytic enzymes are listed in Table 6, with preference given to mesophilic organisms with noncomplexed cellulases. At the same time bacteria from different groups (aerobic vs. anaerobic and meso vs. thermo) were selected, to provide diversity. Also, preferred donors were chosen if the functional expression of their genes in yeast was previously reported (*Thermobifida fusca, Cellulomonas fimi, Clostridium phytofermentans*, etc.). GC content of bacterial genomes also influenced the choice of donor. The preference was given to the organisms with GC content that is not too far from *S. cerevisiae* GC content—38% (see Table 6), although the organisms with high GC content also were not completely ruled out based on successful expression in yeast of native cel9A from *T. fusca* that has 67.5 GC content.

Table 7 gives the full list of the bacterial genes screened for expression in yeast. All the genes except those indicated were successfully amplified by PCR from genomic DNA and transformed into yeast strain together with the 2μ vector backbone for cloning via yeast mediated ligation. The enzymes not cloned from genomic DNA were available as codon optimized versions.

TABLE 6

Characteristics of various bacterial donors of cellulolytic enzymes, DBM-disulphide bonds machinery.

| Organism | Oxygen relation | Growth temp. | Growth pH | Cellulase system | GC content | DBM |
|---|---|---|---|---|---|---|
| *Streptomyces avermitilis* | Aerobe | Meso | 7 | Noncomplexed, cell free | 70.7 | + |
| *Saccharophagus degradans* | Aerobe | Meso | 7.6 | Noncomplexed, cell free | 45.8 | + |

TABLE 6-continued

Characteristics of various bacterial donors of cellulolytic enzymes, DBM-disulphide bonds machinery.

| Organism | Oxygen relation | Growth temp. | Growth pH | Cellulase system | GC content | DBM |
|---|---|---|---|---|---|---|
| *Bacillus subtilis* | Facult. | Meso | 6.8 | Noncomplexed, cell free | 43.5 | + |
| *Clostridium cellulolyticum* | Anaerobe | Meso | 7.5 | Combined | 37.4 | + |
| *Clostridium phytofermentans* | Anaerobe | Meso | 7 | Noncomplexed, cell free | 35.3 | + |
| *Thermobifida fusca* | Aerobe | Thermo | 7.4 | Noncomplexed, cell free | 67.5 | + |
| *Clostridium thermocellum* | Anaerobe | Thermo | 6.7 | Combined | 39 | − |

TABLE 7

Bacterial genes screened for expression in *Saccharomyces cerevisiae*. In certain figures and examples, BC # designates the enzyme used in that experiment.

| Organism | Activity | GHF | Gene or locus taq | Protein ID | BC # |
|---|---|---|---|---|---|
| MESOPHILES | | | | | |
| Aerobes | | | | | |
| *Streptomyces avermitilis* | exo | 6 | 1,4-beta-cellobiosidase guxA1 | NP_821732.1 | 1 |
| *Streptomyces avermitilis* | exo | 6 | 1,4-beta-cellobiosidase guxA2 | NP_823029.1 | 2 |
| *Streptomyces avermitilis* | exo/endo | 48 | 1,4-beta-cellobiosidase guxA3 | NP_823031.1 | 3 |
| *Streptomyces avermitilis* | endoglucahase/xylanase? | 12 | endo-1,4-beta-glucanase celA1 | NP_821730.1 | 4 |
| *Streptomyces avermitilis* | endo | | endo-1,4-beta-glucanase celA2 | NP_823030.1 | 5 |
| *Streptomyces avermitilis* | endo | | endo-1,4-beta-glucanase celA3 | NP_823032.1 | 6 |
| *Streptomyces avermitilis* | endoglucahase/xylanase? | 12 | endo-1,4-beta-glucanase celA4 | NP_823744.1 | 7 |
| *Streptomyces avermitilis* | endo | 6 | endo-1,4-beta-glucanase | NP_826394.1 | 8 |
| *Streptomyces avermitilis* | endo | 6 | endo-1,4-beta-glucanase celA5 | NP_828072.1 | 9 |
| *Streptomyces avermitilis* | endoxylanase | 10 | beta-1,4-xylanase | NP_823272.1 | 10 |
| *Streptomyces avermitilis* | endoxylanase | 10 | beta-1,4-xylanase | NP_826161.1 | 11 |
| *Streptomyces avermitilis* | xylanase/xylosidase ? | 43 | xylanase | NP_827548.1 | 12 |
| *Streptomyces avermitilis* | xylanase/xylosidase ? | 43 | endo-1,4-beta-xylanase xynD | NP_827557.1 | 13 |
| *Streptomyces avermitilis* | xylosidase | 39 | 1,4-beta-xylosidase xynB1 | NP_822628.1 | 14 |
| *Streptomyces avermitilis* | xylanase/xylosidase ? | 43 | beta-xylosidase | NP_823285.1 | 15 |
| *Streptomyces avermitilis* | xylosidase/glucosidase? | 3 | 1,4-beta-xylosidase xynB2 | NP_826159.1 | 16 |
| *Streptomyces avermitilis* | xylosidase | 39 | 1,4-beta-xylosidase xynB3 | NP_827745.1 | 17 |
| *Streptomyces avermitilis* | beta-glucosidase | 1 | beta-glucosidase bglC1 | NP_822977.1 | 18 |
| *Streptomyces avermitilis* | beta-glucosidase | 1 | beta-glucosidase bglC2 | NP_826430.1 | 19 |
| *Streptomyces avermitilis* | beta-glucosidase | 1 | beta-glucosidase bglC3 | NP_826775.1 | 20 |
| *Streptomyces avermitilis* | Acetyl xylan esterase | | AXE1 | NP_822477.1 | 21 |
| *Streptomyces avermitilis* | Acetyl xylan esterase | | AXE1 | NP_822632.1 | 22 |
| *Streptomyces avermitilis* | arabinofuranosidase/xylanase | 43 | abfA | NP_822218.1 | 23 |

TABLE 7-continued

Bacterial genes screened for expression in *Saccharomyces cerevisiae*. In certain figures and examples, BC # designates the enzyme used in that experiment.

| Organism | Activity | GHF | Gene or locus taq | Protein ID | BC # |
|---|---|---|---|---|---|
| *Streptomyces avermitilis* | arabinofuranosidase/ xylanase | | abfB | NP_822290.1 | 24 |
| *Streptomyces avermitilis* | arabinofuranosidase | | abfA | NP_826920.1 | 25 |
| *Streptomyces avermitilis* | arabinofuranosidase/ galactosidase | | abfB | BAC74043.1 | 26 |
| *Streptomyces avermitilis* | arabinofuranosidase | | SAV_6756 | BAC74467.1 | 27 |
| *Streptomyces avermitilis* | galactosidase | | agaA1 | BAC68338.1 | 28 |
| *Streptomyces avermitilis* | galactosidase | | agaA3 | BAC68787.1 | 29 |
| *Streptomyces avermitilis* | galactosidase | | agaB2 | BAC69185.1 | 30 |
| *Saccharophagus degradans* 2-40 | Endo | 5? | Sde_2993 | YP_528462.1 | 31 |
| *Saccharophagus degradans* 2-40 | Endo | 5? | Sde_2996 | YP_528465.1 | 32 |
| *Saccharophagus degradans* 2-40 | Endo | 5? | Sde_3023 | YP_528492.1 | 33 |
| *Saccharophagus degradans* 2-40 | Endo | 5 | cel5A | ABD82260.1 | 34 |
| *Saccharophagus degradans* 2-40 | Endo | 5 | cel5E | ABD82186.1 | 35 |
| *Saccharophagus degradans* 2-40 | Endo | 5 | cel5F | ABD80834.1 | 36 |
| *Saccharophagus degradans* 2-40 | Endo | 5 | cel5J | ABD81754.1 | 37 |
| *Saccharophagus degradans* 2-40 | Endo | 9 | cel9A | ABD79898.1 | 38 |
| *Saccharophagus degradans* 2-40 | beta-glucosidase | 3 | ced3A | ABD81757.1 | 39 |
| *Saccharophagus degradans* 2-40 | beta-glucosidase | 3 | ced3B | ABD79509.1 | 40 |
| *Saccharophagus degradans* 2-40 | beta-glucosidase | 1 | bgl1A | ABD82858.1 | 41 |
| *Saccharophagus degradans* 2-40 | beta-glucosidase | 1 | bgl1B | ABD80656.1 | 42 |
| *Saccharophagus degradans* 2-40 | Cellobiose phosphorylase | 94 | Cep94A | ABD80580.1 | 43 |
| *Saccharophagus degradans* 2-40 | Cellodextrin phosphorylase | 94 | Cep94B | ABD80168.1 | 44 |
| *Saccharophagus degradans* 2-40 | mannanase | | Sde_0509 | YP_525985.1 | 45 |
| *Saccharophagus degradans* 2-40 | mannosidase | 2 | Sde_0169 | YP_525645.1 | 46 |
| Facultative Anaerobes | | | | | |
| *Bacillus subtilis* | synergy with endo/exo | | expansin exlX | CAB13755.1 | 47 |
| *Bacillus subtilis* | endo/exo? | | endo-1,4-beta-glucanase eglS | CAB13696.2 | 48 |
| *Bacillus subtilis* | endo/exo xlylanase? | 30 | endo-xylanase xynC | CAB13698.1 | 49 |
| *Bacillus subtilis* | endo/exo xlylanase? | 43 | endo-1,4-beta-xylanase xynD | CAB13699.1 | 50 |
| *Bacillus subtilis* | endo xlylanase | 11 | endo-1,4-beta-xylanase xynA | CAB13776.1 | 51 |
| *Bacillus subtilis* | xylanase/ xylosidase ? | 43 | xylan beta-1,4-xylosidase xynB | CAB13642.2 | 52 |
| Anaerobes | | | | | |
| *Clostridium phytofermentans* | Exo/Endo | 9 | Cphy_3367 | YP_001560459.1 | 53 |
| *Clostridium phytofermentans* | Exo/Endo | 48 | Cphy_3368 | YP_001560460.1 | 54 |
| *Clostridium phytofermentans* | Endo | 5 | Cphy_2058 | YP_001559165.1 | 55 |
| *Clostridium phytofermentans* | Endo | 5 | Cphy_3202 celulase B | YP_001560295.1 | 56 |
| *Clostridium phytofermentans* | Endo | 5 | Cphy_1163 | YP_001558280.1 | 57 |
| *Clostridium phytofermentans* | beta-glucosidase | 3 | Cphy_3329 | YP_001560421.1 | 58 |

TABLE 7-continued

Bacterial genes screened for expression in *Saccharomyces cerevisiae*. In certain figures and examples, BC # designates the enzyme used in that experiment.

| Organism | Activity | GHF | Gene or locus taq | Protein ID | BC # |
|---|---|---|---|---|---|
| *Clostridium phytofermentans* | beta-glucosidase | 3 | Cphy_1125 | YP_001558242.1 | 59 |
| *Clostridium phytofermentans* | xylanase | 10 | Cphy_1510 | YP_001558623.1 | 60 |
| *Clostridium phytofermentans* | xylanase | 10 | Cphy_0624 | YP_001557750.1 | 61 |
| *Clostridium phytofermentans* | xylanase | 11 | Cphy_2105 XynA | YP_001559210.1 | 62 |
| *Clostridium phytofermentans* | xylanase | 10 | Cphy_2108 | YP_001559213.1 | 63 |
| *Clostridium phytofermentans* | xylanase/ endoglucanase | 8 | Cphy_3207 Y | YP_001560300.1 | 64 |
| *Clostridium phytofermentans* | Xylosidase/ Arabinofuranosidase | 43 | Cphy_0191 | YP_001557317.1 | 65 |
| *Clostridium phytofermentans* | Xylosidase/ Arabinofuranosidase | 43 | Cphy_0875 | YP_001558000.1 | 66 |
| *Clostridium phytofermentans* | Arabinofuranosidase | | Cphy_1169 | YP_001558286.1 | 67 |
| *Clostridium phytofermentans* | Mannanase | 26 | Cphy_1071 | YP_001558190.1 | 68 |
| *Clostridium phytofermentans* | Mannosidase | 26 | Cphy_2128 | YP_001559233.1 | 69 |
| *Clostridium phytofermentans* | Mannosidase | 26 | Cphy_2276 | YP_001559376.1 | 70 |
| *Clostridium phytofermentans* | Galactosidase | | Cphy_1936 | YP_001559043.1 | 71 |
| *Clostridium cellulolyticum* | Endo | 5 | cel5I | AAL79562.1 | 72 |
| *Clostridium cellulolyticum* | Exo/Endo | 48 | CelCCF (dockerin) Cel48F-yeast CO template pMU914 | AAB41452.1 | 73 |
| *Clostridium cellulolyticum* | Xylosidase | 39 | Ccel_1259 | YP_002505595 | 74 |
| *Clostridium cellulolyticum* | Endo | 9 | Ccel_2226 | YP_002506548.1 | 75 |
| *Clostridium cellulolyticum* | Endo/Exo | 9 | Ccel_0732 (dockerin) Cel9E-yeast CO template pMU913 | YP_002505091.1 | 76 |
| *Clostridium cellulolyticum* | Endo | 5 | Ccel_1099 (dockerin) Cel5A-yeast CO template pMU967 | YP_002505438.1 | 77 |
| *Clostridium cellulolyticum* | Endo/Exo | 9 | Ccel_2392 (dockerin) | YP_002506705.1 | 78 |
| *Clostridium cellulolyticum* | Endo | 9 | Ccel_0731 (dockerin) Cel9G-yeast CO template pMU892 | YP_002505090.1 | 79 |
| *Clostridium cellulolyticum* | Endo/Exo | 5 | Ccel_0840 (dockerin) Cel5D-yeast CO template pMU891 | YP_002505196.1 | 80 |
| *Clostridium cellulolyticum* | Endo/Exo | 8 | CelCCC (dockerin) Cel8C-yeast CO template pMU969 | AAA73867.1 | 81 |
| THERMOPHILES Aerobes | | | | | |
| *Thermobifida fusca* | xylanase | 10 | endo-1,4-beta xylanase (Umxyn10A) | ABL73883.1 | 82 |
| *Thermobifida fusca* | xylanase | 11 | endo-1,4-beta-D-xylanase (xyl11) | AAV64879.1 | 83 |
| *Thermobifida fusca* | endo | 6 | Endoglucanase | AAZ55112.1 | 84 |
| *Thermobifida fusca* | exo/endo? | 5 | Cellulase | AAZ56745.1 | 85 |
| *Thermobifida fusca* | beta-glucosidase | 3 | exo-1,4-beta-glucosidase | AAZ55642.1 | 86 |
| *Thermobifida fusca* | beta-glucosidase | 1 | beta-glucosidase | AAZ55664.1 | 87 |
| *Thermobifida fusca* | exo/endo | 48 | cellulose 1,4-beta-cellobiosidase | YP_290015.1 | 88 |
| *Thermobifida fusca* | synergy with endo/exo | | CBD E8 | AAZ55700.1 | 89 |
| *Thermobifida fusca* | exo | 6 | celC (E3) | YP_288681.1 | 90 |
| *Thermobifida fusca* | endo | 5 | celE (E5) | YP_288962.1 | 91 |

TABLE 7-continued

Bacterial genes screened for expression in *Saccharomyces cerevisiae*. In certain figures and examples, BC # designates the enzyme used in that experiment.

| Organism | Activity | GHF | Gene or locus taq | Protein ID | BC # |
|---|---|---|---|---|---|
| *Thermobifida fusca* | endo | 5 | cel5B (Endoglucanase) | AAP56348.1 | 92 |
| *Thermobifida fusca* | endo | 9 | celA (E1) | AAC06387.1 | 93 |
| *Thermobifida fusca* | endo | 6 | celB (E2) | YP_289135.1 | 94 |
| *Thermobifida fusca* | endo/exo? | 9 | Tfu_1627 (1,4-beta-cellobiosidase) | YP_289685.1 | 95 |
| Anaerobes | | | | | |
| *Clostridium thermocellum* | Endo | 8 | celA (dockerin) | YP_001036701.1 | 96 |
| *Clostridium thermocellum* | Endo/Exo | 48 | celY (cel48Y) | CAI06105.1 | 97 |
| *Clostridium thermocellum* | Endo | 9 | Cthe_0625 (dockerin) | YP_001037053.1 | 98 |
| *Clostridium thermocellum* | Endo | 5 | celC | CAC27410.1 | 99 |
| *Clostridium thermocellum* | Endo | 5 | Cthe_1471 | YP_001037893.1 | 100 |
| *Clostridium thermocellum* | xylanase | 10 | Cthe_2119 | YP_001038519.1 | 101 |
| *Clostridium thermocellum* | beta-glucosidase | 1 | bglA | CAA42814.1 | 102 |
| *Clostridium thermocellum* | beta-glucosidase | 3 | bglB | CAA33665.1 | 103 |
| *Clostridium thermocellum* | arabinofuranosidase | 51 | Cthe_2548 | YP_001038942.1 | 104 |
| *Clostridium thermocellum* | arabinofuranosidase | 54 | Cthe_1273 | YP_001037698.1 | 105 |
| *Clostridium thermocellum* | Endo/Exo | 9 | Cthe_0040 (Cel9I) | YP_001036474.1 | 106 |
| *Clostridium thermocellum* | Endo/Exo | 9 | Cthe_0412 (dockerin) | YP_001036843.1 | 107 |
| *Clostridium thermocellum* | Endo/Exo | 9 | Cthe_0825 (dockerin) | YP_001037253.1 | 108 |
| *Clostridium stercorarium* | Endo-xylanase | 11 | xynA | CAD48307 | 109 |
| *Clostridium stercorarium* | Endo-xylanase | 10 | xynB (CelW - celloxylanase) | CAD48313 | 110 |
| *Clostridium stercorarium* | Endo-xylanase | 10 | xynC (CelX - celloxylanase) | CAD48314 | 111 |
| *Clostridium stercorarium* | Xylosidase | 3 | bxlB (b-Xylosidase B) | AJ508405 | 112 |
| *Clostridium stercorarium* | Xylosidase | 39 | bxlA (b-Xylosidase A) | AJ508404 | 113 |
| *Clostridium stercorarium* | Xylosidase/beta-glucosidase | 3 | bglZ (beta-glucosidase) | CAB08072 | 114 |
| *Clostridium stercorarium* | arabinofuranosidase | 43 | arfA (alpha-arabinofuranosidase A) | AJ508406 | 115 |
| *Clostridium stercorarium* | arabinofuranosidase | 51 | arfB (alpha-arabinofuranosidase B) | AAC28125 | 116 |
| *Clostridium stercorarium* | Endo | 9 | celZ (Cs-Cel9Z-Avicellase I) | CAA39010 | 117 |
| *Clostridium stercorarium* | Exo | 48 | celY (Cs-Cel48Y-Avicellase II) | CAA93280 | 118 |
| *Anaerocellum thermophilum* | Endo (Exo?) | 48 | celA (1,4-beta-glucanase) | CAB06786 | 119 |
| *Anaerocellum thermophilum* | Endo | 5 | celD (EG) | CAB01405 | 120 |
| *Anaerocellum thermophilum* | Endo-xylanase | 10 | xynA (1,4-beta-D-xylan xylanhydrolase) | CAA93627 | 121 |
| *Anaerocellum thermophilum* | Endo | 5 | celB (EG5) | Z86104 | 122 |
| *Anaerocellum thermophilum* | Endo? | 5 | Athe_1866 (endo-1,4-beta-mannosidase) | YP_002573059 | 123 |
| *Anaerocellum thermophilum* | Endo? | 5 | Athe_0594 ("cellulase") | YP_002572493 | 124 |
| *Thermobifida fusca* | endo/exo | 9 | Cel9A, TfCel9A-yeast CO gene from restriction digest of pMU1248 | | 125 |

Example 7

Screening Bacterial Endoglucanases for Expression/Activity in Yeast

All of the bacterial endoglucanases were pre-screened for secreted activity on CMC (FIG. 22). Fifty seven yeast strains expressing bacterial endoglucanases were screened. For each enzyme two different transformation clones were assayed. The strains were patched on YPD+Zeo plates (Zeo 250 mg/L) for 2 days and inoculated in 600 uL YPD in 96 well plates. The strains were grown for 3 days at 35 C. at 900 rpm, and the CMC assay (see above) was performed on the supernatants. NegCont is M0749 transformed with empty expression vector pMU1575. TrEG2 in pMU1575 was used as positive control construct.

FIG. 22 demonstrates that 15 bacterial enzymes (26%) displayed secreted activity on CMC. *Bacillus subtilis* EglS and *Clostridium cellulolyticum* Cel5A had secreted activity on CMC similar to the well expressed control, which was *T. reesei* EG2. The enzymes that demonstrated activity on CMC are listed in the Table 8 below. All genes except BC77, BC80 and BC81 are not codon optimized for yeast; therefore the expression level of the best genes could be increased further by codon optimization.

Example 8

Synergy of Bacterial Endoglucanases with Yeast Made CBHs on PHW

Figure 23:
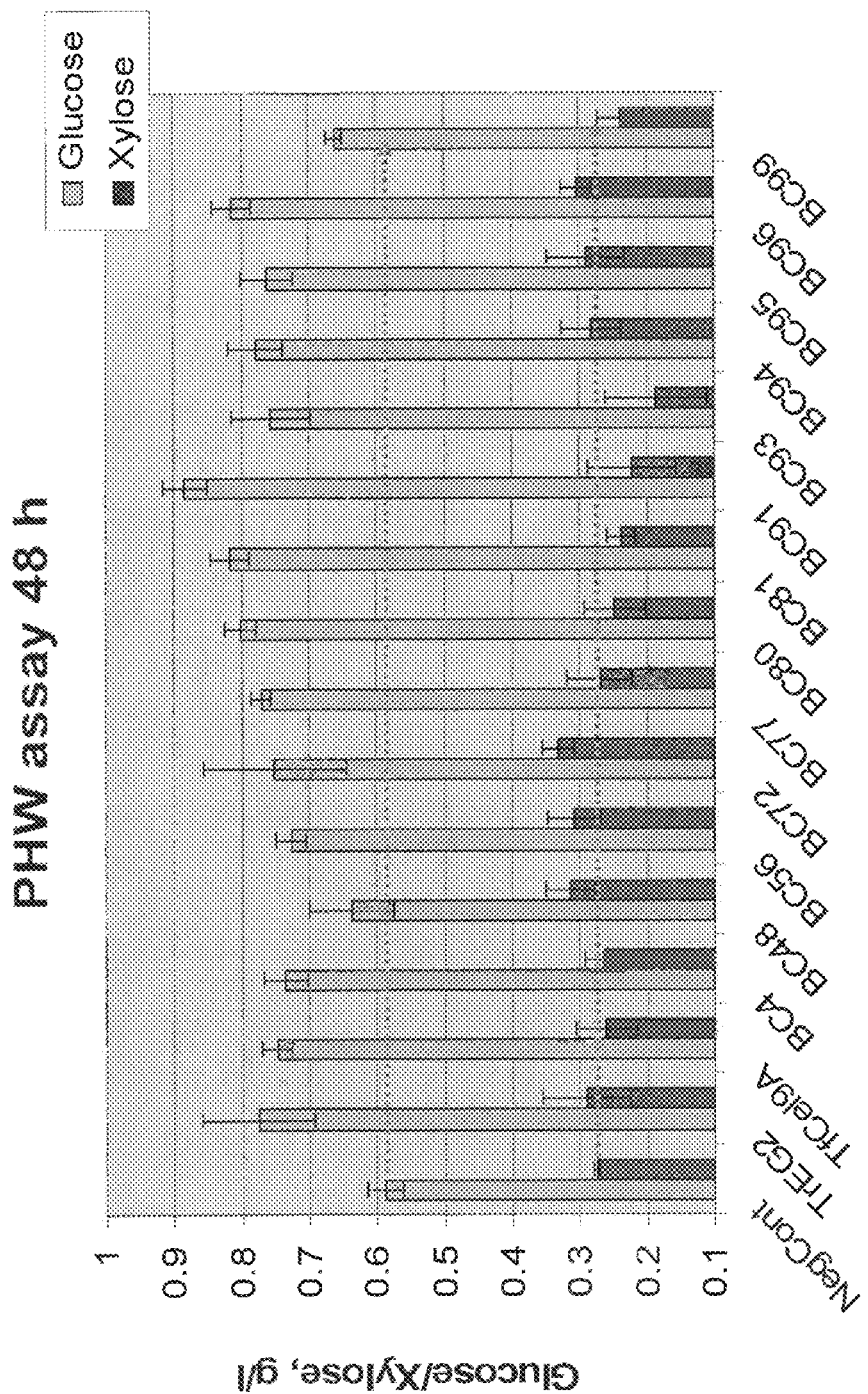
FIG. 23 depicts results from a PHW assay with yeast-made bacterial endoglucanases (see Table 7) in the presence of yeast made purified CBH1 and CBH2. All wells were supplemented with 3.5 mg/g TS BGL (Novozyme-188) and 2 mg/g TS yeast made purified CBH1+CBH2 (ratio 1:1). Supernatant of the strain expressing empty vector was used as negative control.

In order to determine which bacterial endoglucanase increase pretreated lignocellulose conversion by CBHs, the PHW assay was performed with several yeast made bacterial EGs selected by screening on CMC in the presence of yeast made purified CBH1 and CBH2 (FIG. 23). The assay was also supplemented with Novozyme-188 BGL.

FIG. 23 demonstrates that almost all tested bacterial EGs significantly increase glucose release from PHW. Additive effect of bacterial EGs was similar or higher compared to the positive control—*Trichoderma reesei* EG2. *Thermobifida fusca* celE was particularly successful among the EGs.

Figure 24:
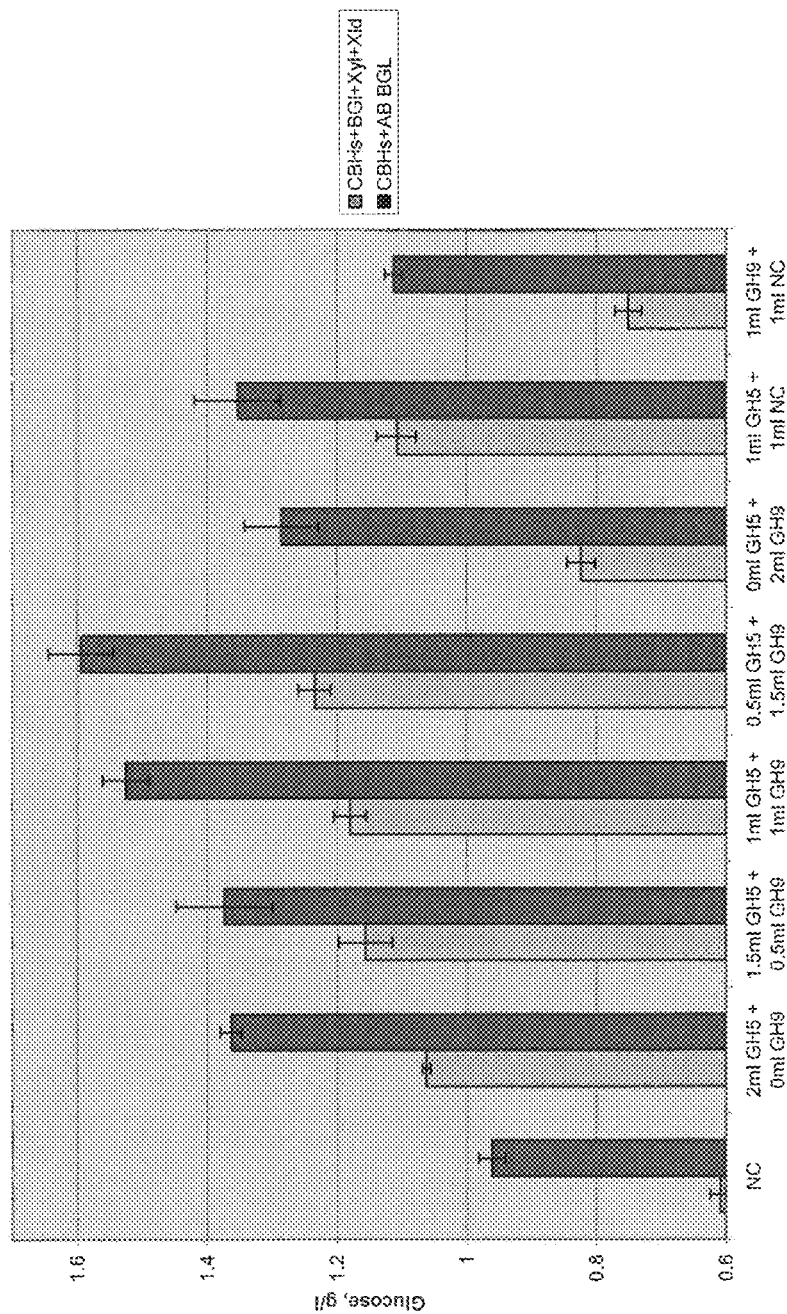
FIG. 24 depicts results from an assay measuring glucose release from PHW provided by different combinations of bacterial GH9 EG (*T. fusca* Cel9A) and fungal GH5 EG (*T. reesei* EG2). The negative control (empty vector) was added in amount of 2 ml. Compositions of all other samples are shown on the figure. Left side bars depict results from samples that were supplemented by purified yeast made enzymes (1 mg/g CBH1, 1 mg/g CBH2, 0.2 mg/g BGL) plus not purified yeast made xylanase (BC60, 100 ul/well) and xylosidase (M1381, 100 ul/well). Right side bars depict results from samples that were supplemented with the same amount of purified CBHs plus 1 mg/g AB BGL.

Previous work had demonstrated that the *T. fusca* Cel9A gene is well expressed in yeast. We have generated a yeast codon optimized version of this gene and expressed it and the native sequence under control of the strong ENO1 promoter. This resulted in activity on avicel that was roughly equivalent to that measured for CBH1 candidates (8% conversion in 48 hours, with only Novozymes 188 present as a background). This indicated that both the native and the codon optimized version of the gene were well expressed. Thus, this candidate enzyme was tested for synergy with yeast made, purified CBHs, and *T. reesei* EG2 in a PHW assay (FIG. 24). As can be seen below, combinations of Cel9A with EG2 have significant synergy, and perform better than the individual enzymes added alone, even though they are twice the concentration.

TABLE 8

List of bacterial endoglucanases demonstrated functional expression in yeast (see FIG. 22).

| BC# | Donor organism | GHF | Gene or locus taq |
|---|---|---|---|
| 4 | *Streptomyces avermitilis* | 12 | endo-1,4-beta-glucanase celA1 |
| 34 | *Saccharophagus degradans* | 5 | cel5A |
| 48 | *Bacillus subtilis* | | endo-1,4-beta-glucanase eglS |
| 56 | *Clostridium phytofermentans* | 5 | Cphy__3202 celulase B |
| 72 | *Clostridium cellulolyticum* | 5 | cel5I |
| 77 | *Clostridium cellulolyticum* | 5 | Ccel__1099 (yeast CO) |
| 80 | *Clostridium cellulolyticum* | 5 | Ccel__0840 (yeast CO) |
| 81 | *Clostridium cellulolyticum* | 8 | CelCCC (yeast CO) |
| 91 | *Thermobifida fusca* | 5 | celE (E5) |
| 93 | *Thermobifida fusca* | 9 | celA (E1) |
| 94 | *Thermobifida fusca* | 6 | celB (E2) |
| 95 | *Thermobifida fusca* | 9 | Tfu__1627 |
| 96 | *Clostridium thermocellum* | 8 | celA |
| 99 | *Clostridium thermocellum* | 5 | celC |
| 108 | *Clostridium thermocellum* | 9 | Cthe__0825 |
| 125 | *Thermobifida fusca* | 9 | Cel9A |

Example 9

Characterizing Bacterial Xylanases for Expression/Activity in Yeast

Figure 25A:
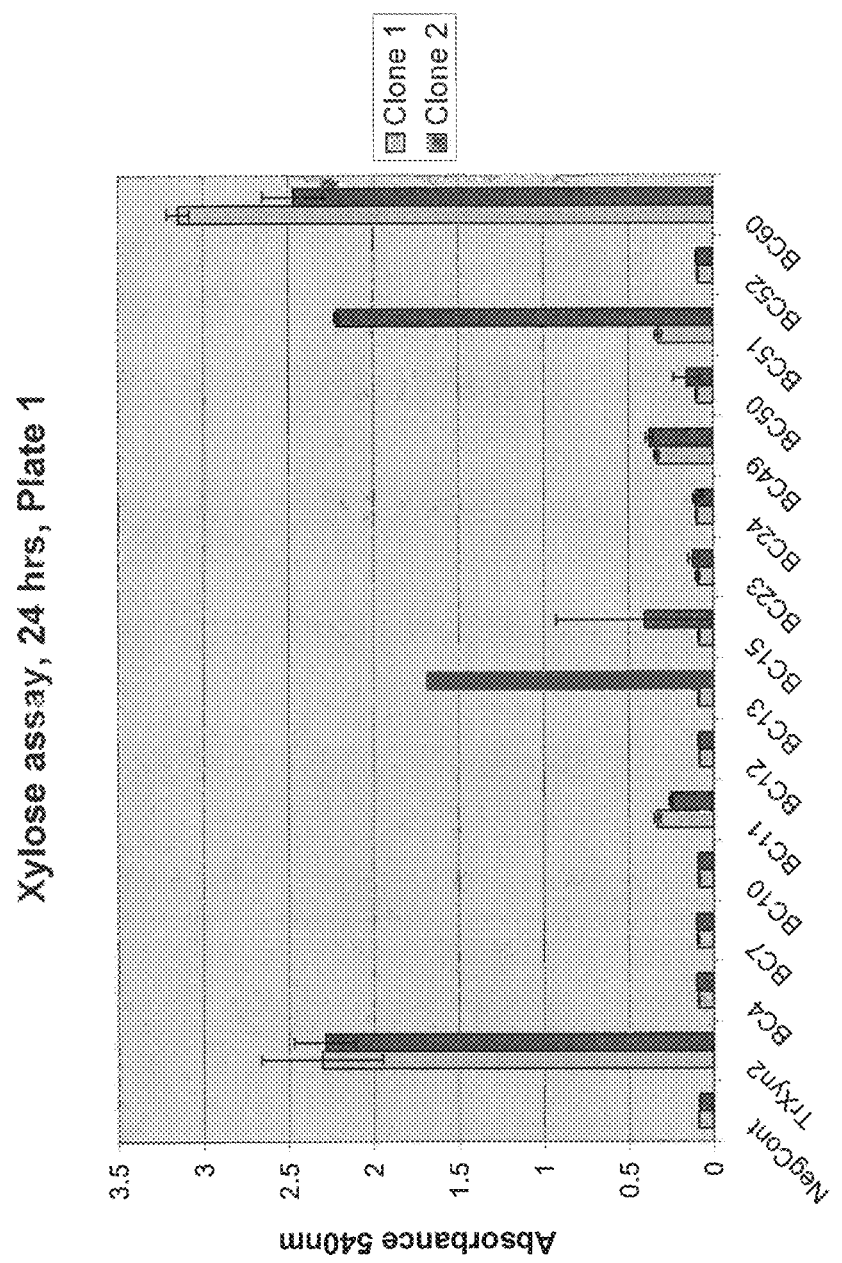
FIG. 25A and FIG. 25B depict results of an assay of secreted activity on birchwood xylan for bacterial xylanases expressed in yeast. Strains were patched on YPD+Zeo plates (Zeo 250 mg/L) for 2 days and inoculated in 600 μL YPD in 96 well plate. Plates were then grown for 3 days at 35° C. at 900 rpm. Standard xylose assay (DNS based) was performed on s. All strains have M0749 background. The negative control is M0749 transformed with empty expression vector pMU1575. *T. reesei* Xyn2 in pMU1575 was used as positive control construct.
Figure 25B:
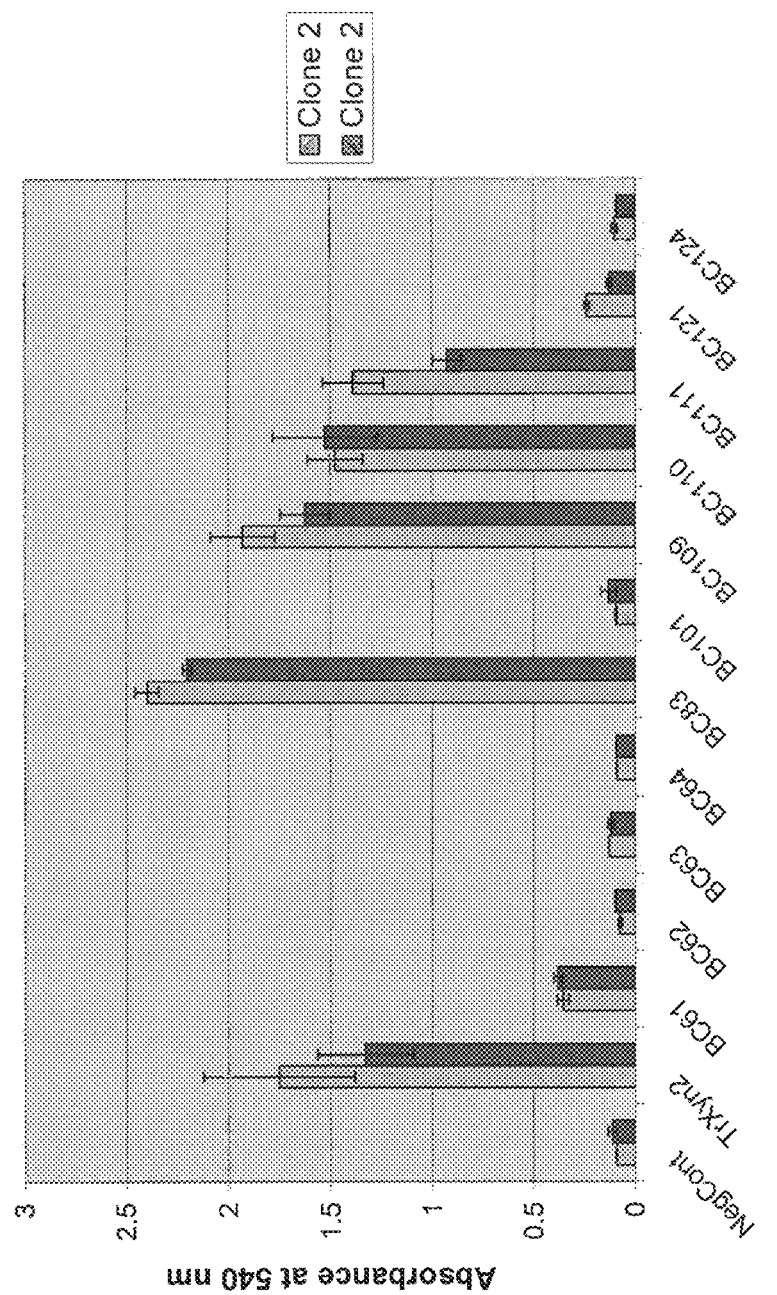

Screening was carried out for bacterial genes annotated as xylanases using birchwood xylan as the substrate—see protocol above (FIG. 25). Twenty five yeast strains expressing bacterial xylanases were screened. For each enzyme two different transformation clones were assayed. The strains were grown in the same manner as the endoglucanases described above. All strains have M0749 yeast background. "NegCont" is M0749 transformed with empty expression vector pMU1575, and the *Trichoderma reesei* Xyn2 gene cloned into in pMU1575 was used as positive control construct.

FIG. 25 demonstrates that 8 bacterial enzymes (32%) had secreted activity on xylan. Several xylanases including *Clostridium phytofermentans* Cphy1510 (GHF10) and *Thermobifida fusca* xyl11 had secreted activity on xylan similar to or higher than *T. reesei* Xyn2. The enzymes that demonstrated activity on xylan are listed in Table 9 below.

TABLE 9

List of bacterial xylanases demonstrated functional expression in yeast (see FIG. 25).

| BC# | Donor organism | GHF | Gene or locus taq |
|---|---|---|---|
| 13 | *Streptomyces avermitilis* | 43 | endo-1,4-beta-xylanase xynD |
| 51 | *Bacillus subtilis* | 11 | endo-1,4-beta-xylanase xynA |
| 60 | *Clostridium phytofermentans* | 10 | Cphy__1510 |
| 61 | *Clostridium phytofermentans* | 10 | Cphy__0624 |
| 83 | *Thermobifida fusca* | 11 | endo-1,4-beta-D-xylanase (xyl11) |
| 109 | *Clostridium stercorarium* | 11 | xynA |
| 110 | *Clostridium stercorarium* | 10 | xynB (CelW - celloxylanase) |
| 111 | *Clostridium stercorarium* | 10 | xynC (CelX - celloxylanase) |

Example 10

Synergy of Bacterial Xylanases with Yeast Made CBHs and EG

In order to test synergy of yeast made enzymes with bacterial xylanases, a PHW assay was performed with several yeast made bacterial xylanases previously selected by screening on xylan in the presence of yeast made purified CBH1, CBH2, TrEG2, and yeast made GH43 xylosidase (from *Pyrenophora tritici-repentis*) (FIG. 26). *Trichoderma reesei* Xyn2 was used as the positive control, and a strain expressing an empty vector served as a negative control. The assay was also supplemented with AB BGL.

FIG. 25 demonstrates that some bacterial xylanases significantly increase glucose release from PHW, especially when external enzyme is not present. *Clostridium phytofermentans* GH10 xylanases (BC 60, and BC61) and *Clostridium stercorarium* XynB (BC110) had the most significant effect on glucose release from PHW. There are several possible explanations for the fact that these xylanases help release glucose. It is possible that some xylanases also possess endoglucanase or other hydrolase activity, and thus hydrolyze cellulose directly. Additionally, it is possible that digestion of xylan in the PHW may make the cellulose more accessible for the cellulases present in the reaction. Increased release of xylose was not measured in the reaction, likely due to the lack of appropriate complementary activities (xylosidase and/or acetylxylanesterase).

Example 11

Cloning and Screening *Thermoanaerobacter saccharolyticum* Xylanases

Figure 26:
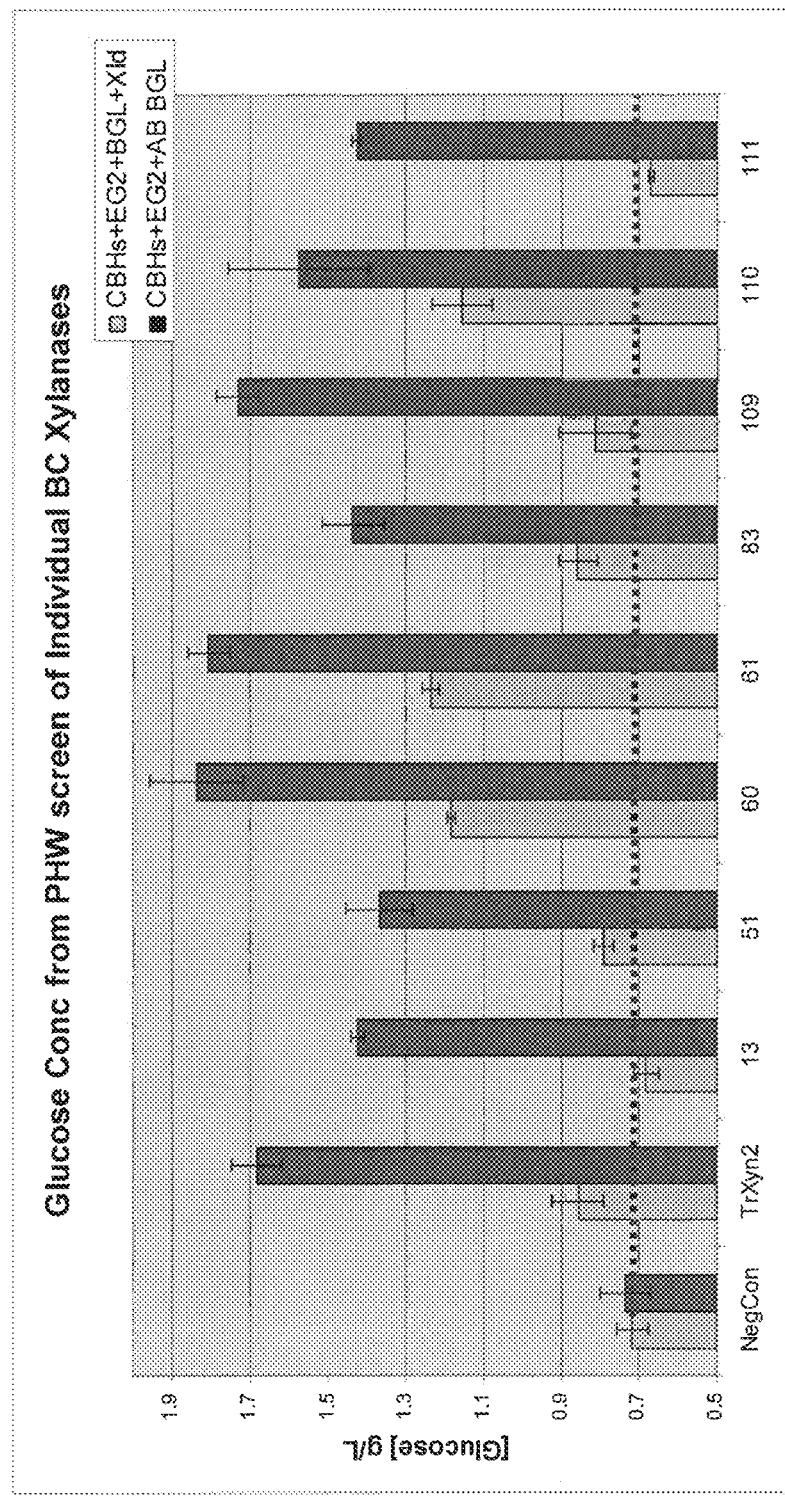
FIG. 26 depicts the results of an assay measuring the effect of yeast made xylanases on glucose release from PHW by yeast made cellulases measured by PHW assay. Left-side bars depict results from an assay that was supplemented with yeast made purified cellulases (CBH1-1 mg/g TS; CBH2-1 mg/g TS; EG2-0.4 mg/g TS, BGL-0.2 mg/g TS) and yeast made unpurified *Pyrenophora tritici-repentis* β-xylosidase (GH43, M1381)—50 ul sup/4 ml reaction. M1381 strain expressing xylosidase was grown in YPD in shake flask for 3 days. Right side bars depict results from an assay that was supplemented with the same amount of yeast made purified CBH1, CBH2 and EG2 plus 1 mg/g TS AB BGL (ME057). The glucose was measured by a glucose hexokinase kit (Sigma). Each experiment was performed in triplicates. Supernatant from a strain expressing empty vector was used as negative control (NegCon). Supernatant expressing fungal *T. reesei* Xyn2 was used as positive control.
Figure 27:
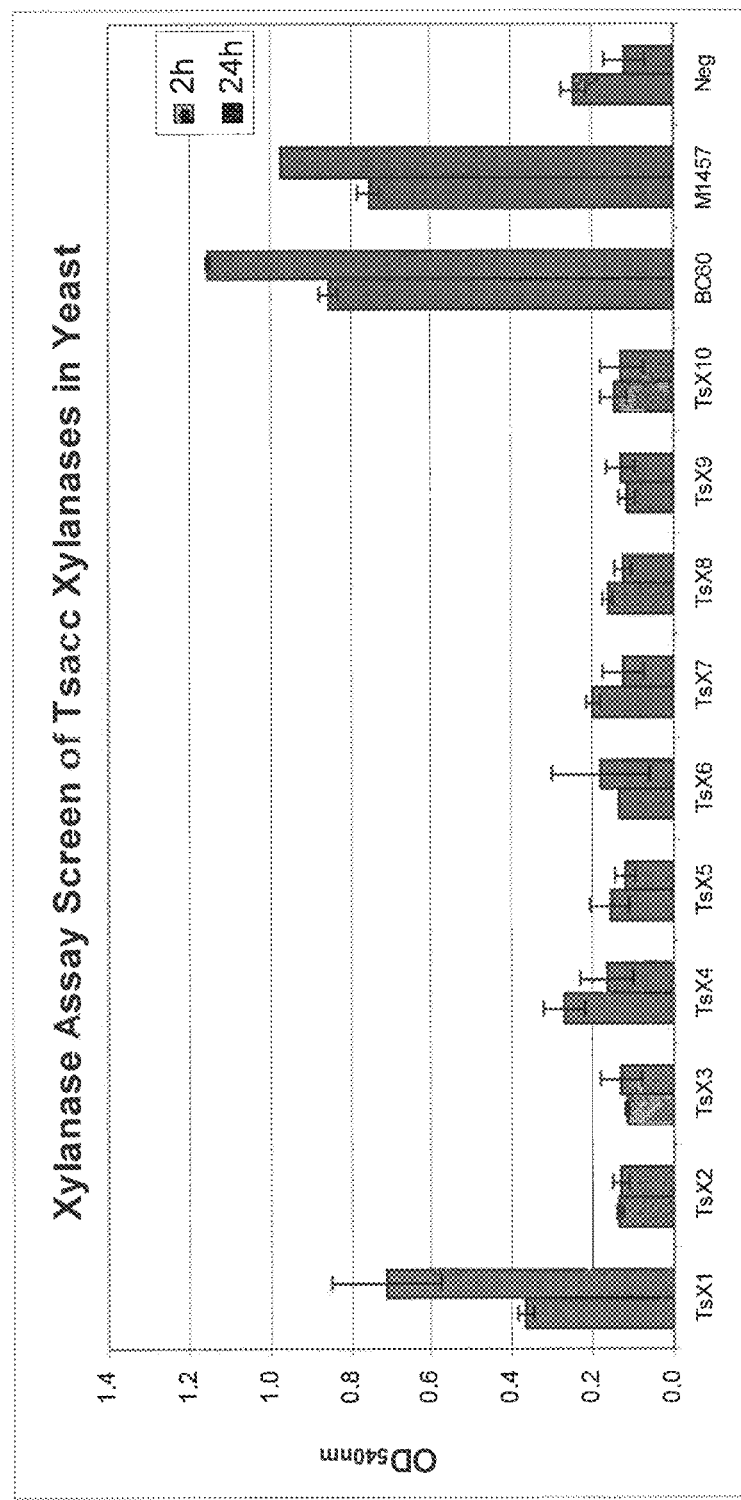
FIG. 27 depicts results from a xylanase assay in which yeast strains expressing *T. saccharolyticum* xylanase genes were evaluated.

*T. saccharolyticum* xylanases were cloned from genomic DNA and fused to the Eno1 promoter for expression in *S. cerevisiae*. A total of 12 xylanase-related genes were cloned into the pMU1575 backbone (Table 4). The strains were screened for both xylanase and xylosidase activities using the birchwood xylanase assay and the pNPX xylosidase assay, respectively (FIG. 26). M1594 was the only strain that demonstrated significant xylanase activity. No xylosidase activity was detected from these strains.

Example 12

Screening of Bacterial Genes with Mannanase Activity

In order to find an easy, high-throughput screen for cellulases, mannanases, and xylanases, 4 Azurine-Crosslinked Polysaccharides (AZCL) from Megazymes were tested in an agar plate assay. In this assay the enzyme hydrolyzes the insoluble polysaccharide, releasing the soluble dye-labeled fragments to provide a "zone of dyeing". Galactomannan, debranched arabinan, and xylan AZCL attached substrates were tested by the plate assay. Clones with putative xylanase, and mannanase activity provided colored zones; however, no arabinase activity was detected on the debranched arabinan.

Xylanases that demonstrated activity by this plate assay matched the ones that were active in previously applied birchwood xylan assay (see above). Three functionally secreted yeast made bacterial mannanases (BC68, BC69, and BC70 from *C. phytofermentens*) were discovered by the mannanase plate assay.

Figure 28:
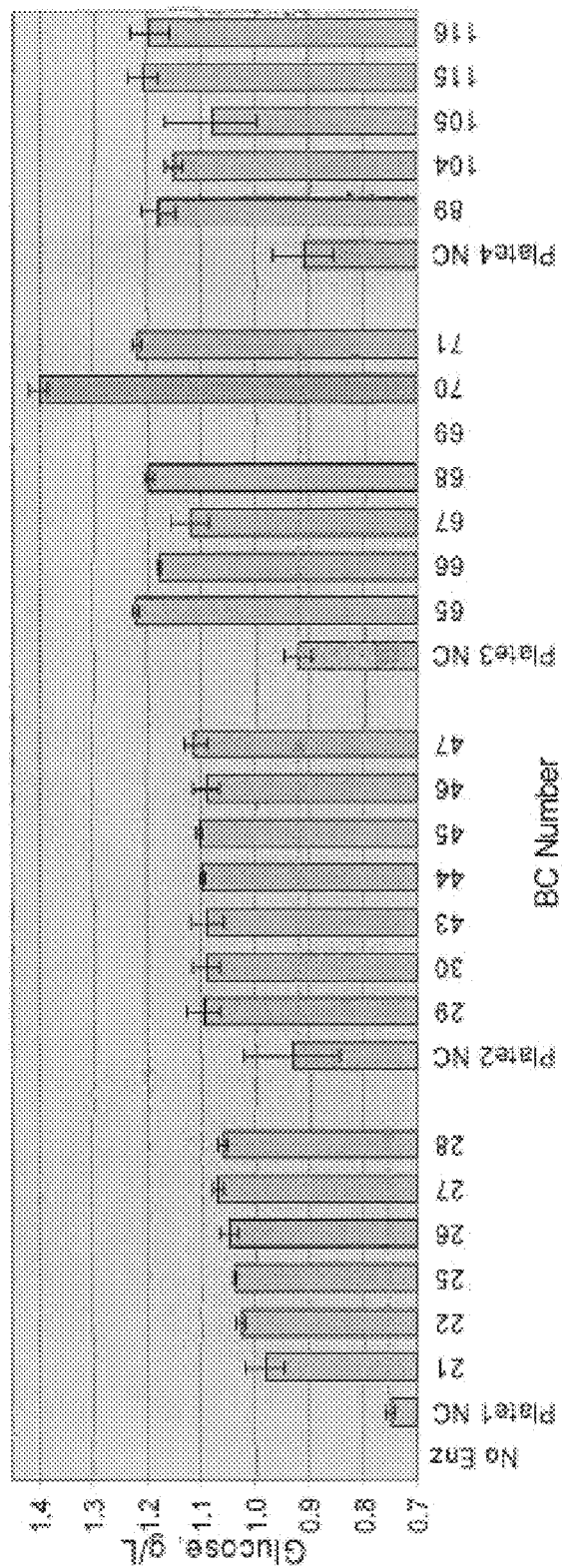
FIG. 28 depicts results from an assay measuring glucose release from PHW provided by bacterial accessory enzymes in the presence of yeast made enzymes. A standard PHW assay was performed. Glucose was measured by HPLC. The sample numbers mean BC numbers (see Table 7). All samples were added in amount of 2 ml. All samples including NC (negative control) were supplemented with purified 1 mg/gCBH1, 1 mg/gCBH2, 0.4 mg/gEG2, 0.2 mg/g BGL; not purified 2.5% (v/v) xylanase (M1457) and 2.5% (v/v).

Bacterial accessory enzymes expressed by yeast were also screened for synergy with yeast made enzymes (CBH1, CBH2, EG2, BGL, xylanase, xylosidase) by PHW assay without any external enzymes added (FIG. 28). One enzyme—*Clostridium phytofermentans* mannosidase (Cphy_2276, GH26, BC70), has a noticeable effect on glucose release from PHW. None of the enzymes had significant effect on xylose release. It is possible that other activities may be needed in a system in order to notice the effect of some accessory enzymes.

TABLE 10

Description of *T. saccharolyticum* xylanases cloned and expressed in yeast.

| Sample | Contig | Gene | SP | Gene Annotation | GH | Vector # |
|---|---|---|---|---|---|---|
| TsX1 | Contig7 | orf0901 | Trans | endo-1,4-beta-xylanase precursor | 11 | pMU1988 |
| TsX2 | Contig12 | orf1447 | No | Xylan 1,4-beta-xylosidase | 39 | pMU1989 |
| TsX3 | Contig12 | orf1446 | No | Xylan 1,4-beta-xylosidase. | 52 | pMU1990 |
| TsX4 | Contig12 | orf1454 | Trans | Cellulose 1,4-beta-cellobiosidase - Beta-1 4-xylanase xynA | 10 | pMU1991 |
| TsX5 | Contig12 | orf1455 | No | Glycosyl hydrolase family 10 | 10 | pMU1992 |
| TsX6 | Contig12 | orf1186 | SP | xylanase/chitin deacetylase |  | pMU1993 |
| TsX7 | Contig0 | orf0277 | No | xylulokinase |  | pMU1994 |
| TsX8 | Contig0 | orf0278 | No | xylose isomerase xylA |  | pMU1995 |
| TsX9 | Contig0 | orf0277 | No | xylulokinase - No SP |  | pMU1996 |
| TsX10 | Contig0 | orf0278 | No | xylose isomerase xylA - No SP |  | pMU1997 |

TABLE 11

Summary of functional, "best in class" component expressed in yeast.
Hardwood and Paper sludge
Additional for Paper sludge

| Type of Activity | Cazy family/ enzyme type | Well-Expressed Candidates | Accession Number |
|---|---|---|---|
| exoglucanase | GH7A (CBH1) | T. emersonii CBH1 + HgCBD | See underlined orf in pMU1392 |
|  | GH6A (CBH2) | C. lucknowense CBH2 | See omnibus patent application |
| endoglucanase | GH7B (EG1) | A. fumigatus EG 1 | XP_747897 |
|  | GH5A (EG2) | T. reesei EG2 | See omnibus patent application |
|  | GH12A (EG3) | N. fischeri EG3 | XP_001261563 |
|  | GH61A (EG4) | T. terrestris EG4 | ACE10231 |
|  | GH45A (EG5) | C. lucknowense EG5 | ACH15008 |
|  | GH6 (EG6) | N. crassa EG6 | XP_957415 |
|  | GH5 (bact.) | C. cellulolyticum Cel5A | YP_002505438.1 |
|  | GH? (bact.) | B. subtilis EGLS | CAB 13696.2 |
|  | GH9 (bact.) | T. fusca Cel9A | AAC06387.1 |
|  | GH8 (bact.) | C. cellulolyticum Cel8c | AAA73867.1 |
| xyloglucanase | GH74A (EGL6) | A. niger XG | AAK77227 |
| β-glucosidase | BGLI | S. fibuligera BGLI | See Omnibus patent application |
| xylanase | GH11 (XYN2) | T. reesei xyn2 | ABK59833 |
|  | GH10 | A. niger xyn10 | CAA03655.1 |
| β-xylosidase | GH3 | A. niger Xld3 | XP_001389416 |
|  | GH43 (BXL1) | Pyrenophora tritici-repentis BXL | XP_001940956 |
| beta-mannase | GH5 (MAN1) | A. aculeatus MAN5 | AAA67426 |
| beta-mannosidase | GH2/GH26 | C. phytofermentens mannosidase |  |
| acetylxylanesterase | CE1 (AXE) | N. fischerii AXE1 | XP_001262186 |
| arabinofuranosidase | GH54 (ABF1) | A. niger ABFB | AAA93264 |
| ferulic acid/cinnamoylesterase | CE1 (FAEA) | A. niger FAEA | xp_001393337 |
|  | CE1 (FAEB) | T. stipitatus FAEB | EED17739 |
| A-glucuronidase | GH67 | Pichia stipitis | ABN67901 |
| glucuronyl esterase | CIP2 | C. globosum | XP_001226041 |

Example 13

Combinations of Components to Enhance Hydrolysis: Effect of Different EG Combinations (Pair Wise Combinations) on PHW Conversion by Yeast Made CBHs in the Presence of External Enzymes (EE)

In order to determine if different EGs were synergistic with each other, PHW assays were used to analyze EG combinations with the goal of determining synergistic relationships. If the EGs had similar functions, then combinations of the EGs should be no better than a single EG (either) loaded at twice the concentration. However, if the EGs were synergistic, then combinations should yield greater hydrolysis than a 2× concentration of either enzyme.

Figure 29A:
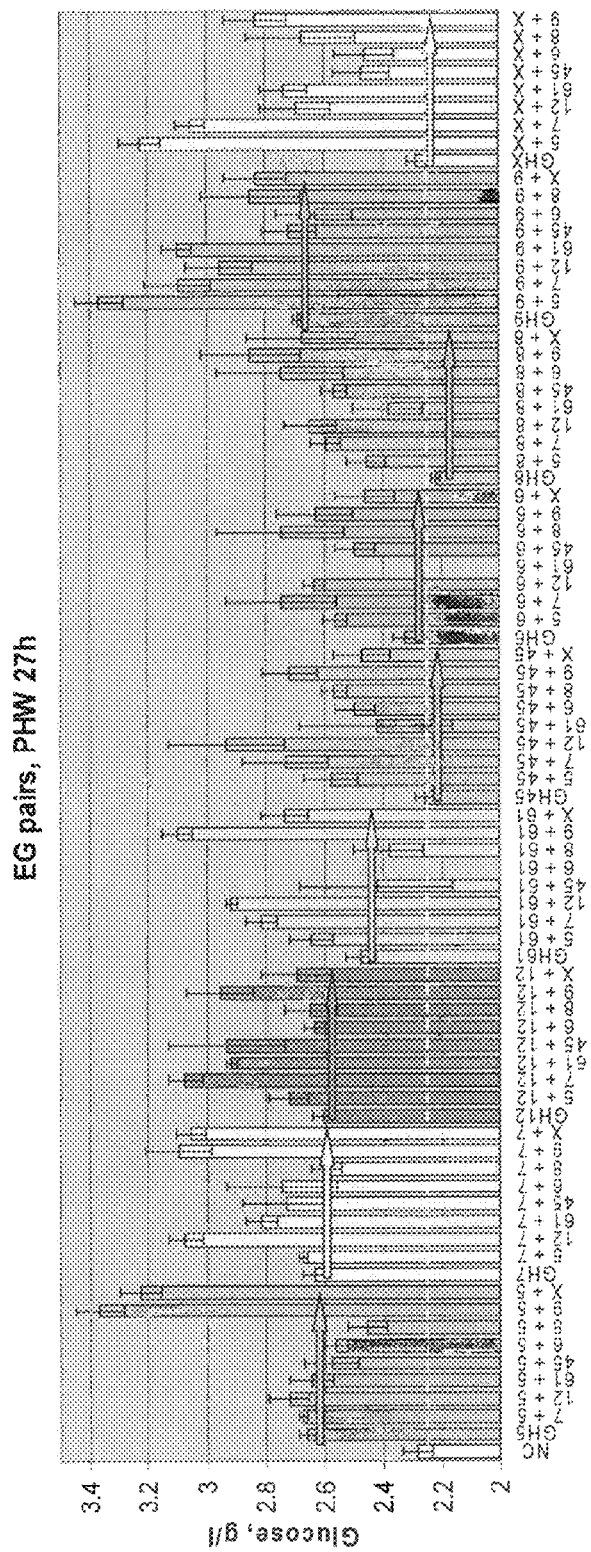
FIG. 29A and FIG. 29B depict results from an assay measuring glucose release from PHW provided by different combinations (pairs) of EGs that belong to different GH families. Glucose was measured by glucose hexokinase kit. The samples were taken at 27 hrs (A) and 48 hrs (B). The sample numbers are the GHF numbers (see Tables below). NegCon (NC—empty vector) supernatant was added in amount of 2 ml. The first bar in each colored block is 2 ml of single EG. All other bars in each colored block represent a combination of two different EGs (1 ml each). All samples including NC were supplemented with 1 mg/g CBH1+1 mg/gCBH2+4 mg/g EE. EE—External Enzymes was composed of 3.25 mg/g ME50-2 (cellulase Novozyme22C, batch# CZP00004, Novozymes); 0.25 mg/g ME54-2 (xylnase XYN30, batch# EL2007020L, EB Enzymes; 0.25 mg/g ME57 (β-glucosidase ABK, batch# EL2008044L. EB Enzymes; and 0.25 mg/g ME64 (Pectinase FE, batch#1660 05×/1 m 401-083-3580, Genencor). MS630 (a pretreated hardwood) was used as substrate. All experiments were performed in triplicate. The missing bars or the bars without error bars had all or most of the repeats fail.
Figure 29B:
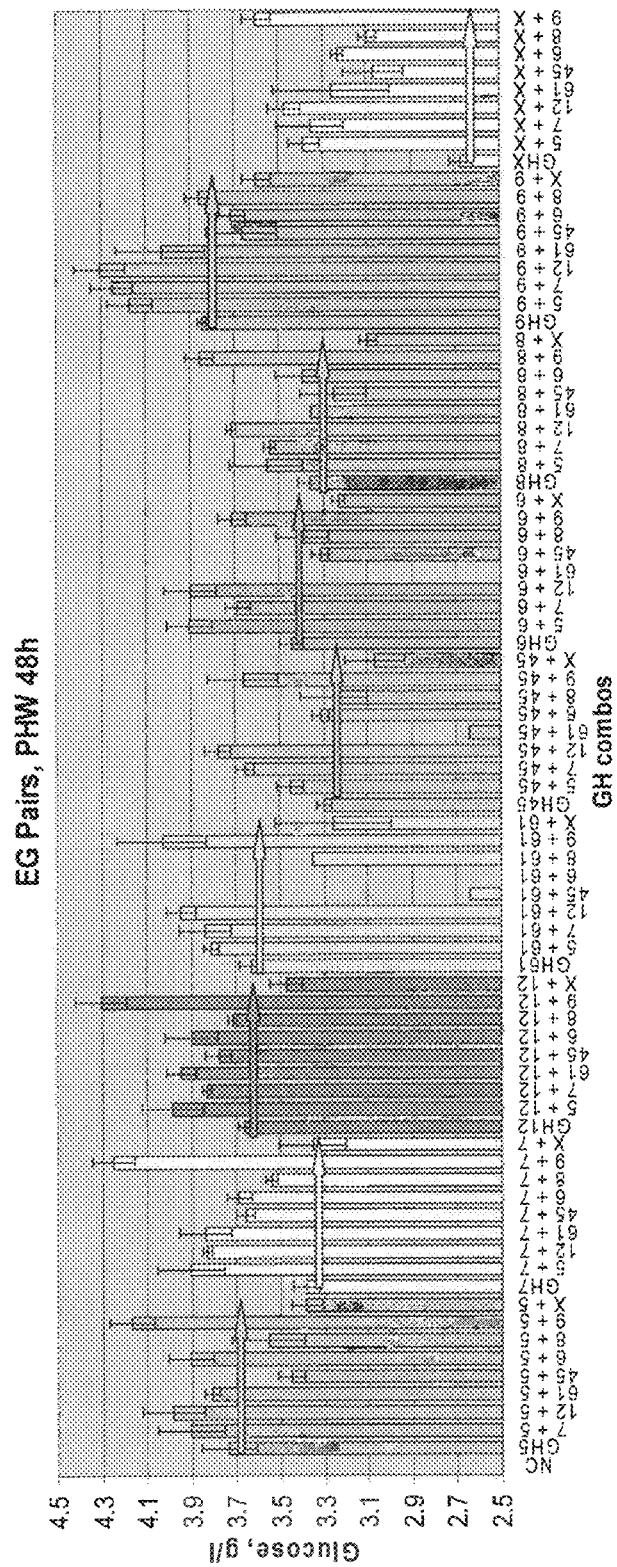

To test pair wise combinations, a PHW assay was performed with the supernatants of yeast strains expressing individual EGs (Table 4) combined in pairs (1 ml+1 ml) in all possible combinations. The EG expressing strains were patched on YPD+Zeo plates for 1 day (except M1023 that was patched on SD-URA), inoculated in YPD in shake flasks and grown for 72 hours. The strain expressing an empty vector was used as negative control (2 ml, NC). The strains expressing single EGs (2 ml or 1 ml+1 mlNC) were used as positive controls. All samples including NC were supplemented with 1 mg/g CBH1, 1 mg/g CBH2, and 1 mg/g AB BGL (FIG. 29) or 1 mg/g CBH1, 1 mg/gCBH2, 0.2 mg/g BGL, and 1 mg/g Zoomerase (FIG. 29).

TABLE 12

Yeast strains expressing EGs of different GH families.

| GHF | Strain | Organism | Donor | Gene | Host |
|---|---|---|---|---|---|
| GH7 | M1311 | Fungi | Aspergillus fumigatus | EG1 | M0509 |
| GH5 | M1450 | Fungi | Trichoderma reesei | EG2 | M0749 |
| GH12 | M1378 | Fungi | Neosartorya fischeri | EG3 | M0509 |
| GH61 | M1391 | Fungi | Chaetomium globosum | EG4 | M0509 |
| GH45 | M1420 | Fungi | Chaetomium globosum | EG5 | M0544 |
| GH6 | M1400 | Fungi | Neurospera crassa | EG6 | M0509 |
| GH8 | M1456 | Bacteria | Clostridium cellulolyticum | Cel8C(BC81) | M0749 |
| GH9 | M1023 | Bacteria | Thermobifida fusca | Cel9A(BC125) | M0749 |
| GHX | M1454 | Bacteria | Bacillus subtilis | EglS(BC48) | M0749 |

All EGs expressed on 2 u plasmid under ENO pr/tt containing URA3 and Zeo markers. Backbone vector pMU1531 for fungal EGs; pMU1575 for bacterial EGs. Fungal EGs have native signal sequences; bacterial EGs attached to S.c.Invertase signal. Strains with fungal EGs were selected on YPD+Zeo plates; strains with bacterial EGs were selected on SD-URA-plates.

As can be seen from FIG. 29, several combinations of EGs outperformed a 2× loading of either enzyme, indicating that the EGs are indeed synergistic. Even though there was some overlap in synergy between different time-points (27 and 48 hrs), the amount of synergy was changing over time.

Figure 32:
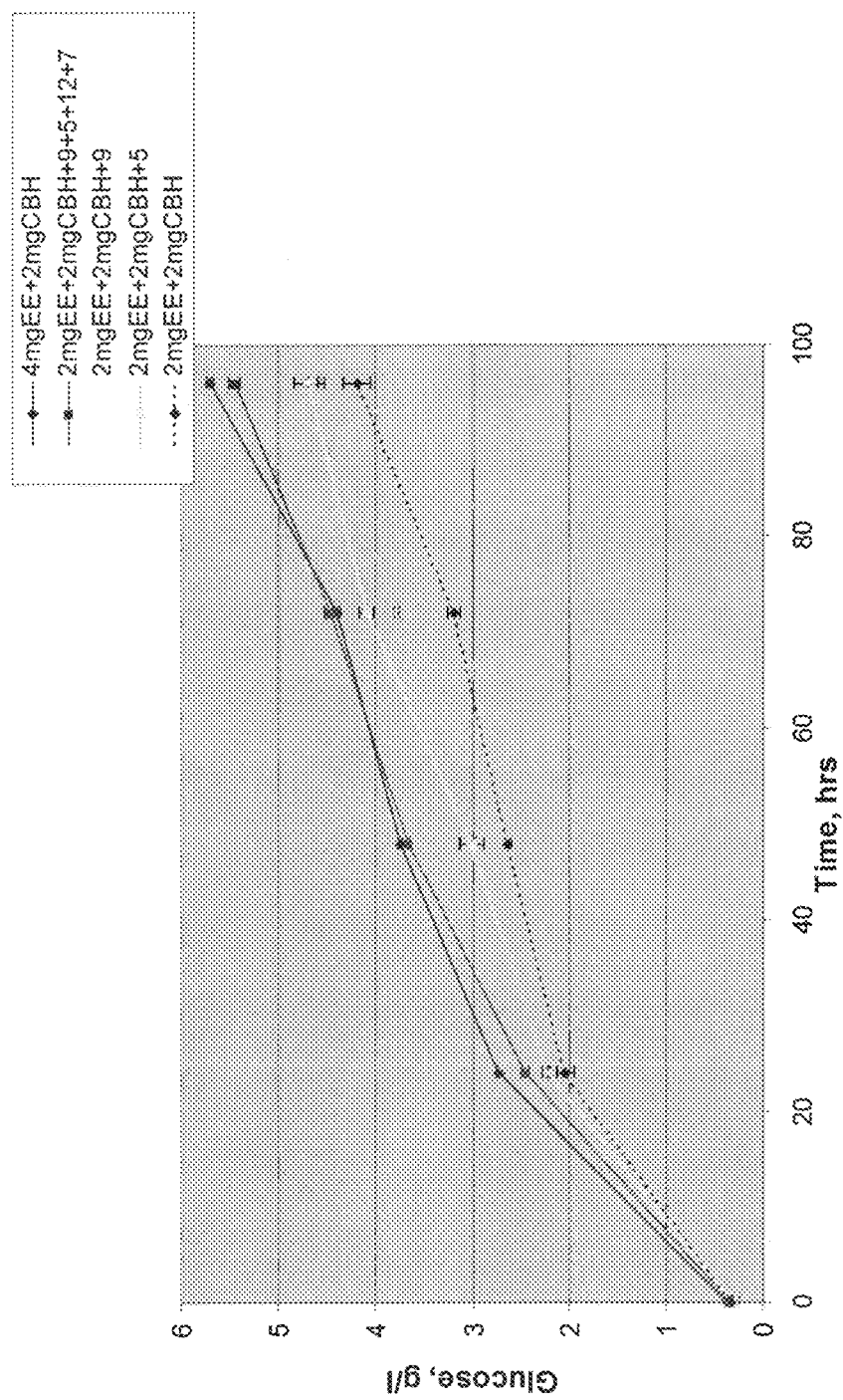
FIG. 32 depicts a time course of glucose release from PHW provided by selected samples from FIG. 31.

In order to analyze the EG pairs experiment data the Tables 13A and 13B were composed based on FIGS. 31 and 32 data. In these Tables two parameters were calculated for each EG pair: activity (red numbers)—increase in glucose release compared to NegCont; and synergy (black numbers)—increase in glucose release compared to the more active component of the couple. Activity was calculated by deducting the glucose release value for negative control from glucose release value for EG couple. Synergy was calculated as % of increase in glucose release for EG pair compared to the glucose release for the more active component of the pair. The data presented on FIGS. 33 and 34 and Tables 13A and B demonstrated that:

1. EG combinations have a definite advantage in PHW cellulose conversion compared to single EGs.
2. In early PHW conversion time points each of the 9 EGs (from separate families) are synergistic with some other EG.
3. The synergy effect becomes less noticeable at the later time of conversion.

In order to select the most efficient EG couples, the best EG pairs were ranged based on both parameters: activity and synergy, for both time-points (Table 14). The pairs highlighted green in the Table 14 are present in all four "winning" groups and considered as the most efficient EG combinations for these experimental conditions.

TABLE 13

Data analysis of experiment with different EG combinations.

A
PHW glucose 27 h

| GH | 5 | 7 | 12 | 61 | 45 | 6 | 8 | 9 | X |
|---|---|---|---|---|---|---|---|---|---|
| 5 | 0.38 | 0 | 0 | 0 | 0 | 0 | 0 | 28 | 21 |
| 7 | 0.39 | 0.35 | 17 | 7 | 0 | 0 | 0 | 15 | 16 |
| 12 | 0.44 | 0.39 | 0.3 | 12 | 13 | 0 | 0 | 10 | 0 |
| 61 | 0.36 | 0.59 | 0.33 | 0.20 | ? | ? | 0 | 15 | 10 |
| 45 | 0.30 | 0.45 | 0.34 | ? | 0 | 7 | 14 | 0 | 8 |
| 6 | 0.28 | 0.46 | 0.35 | ? | 0.21 | 0 | 18 | 0 | 6 |
| 8 | 0.18 | 0.31 | 0.37 | 0.10 | 0.28 | 0.43 | 0 | 6 | 17 |
| 9 | | 0.82 | 0.40 | 0.82 | 0.44 | 0.35 | 0.57 | 0.41 | 5 |
| X | | 0.78 | 0.41 | 0.46 | 0.19 | 0.18 | 0.40 | 0.55 | 0 |

B
PHW glucose 48 h

| GH | 5 | 7 | 12 | 61 | 45 | 6 | 8 | 9 | X |
|---|---|---|---|---|---|---|---|---|---|
| 5 | | 4 | 7 | 0 | 0 | 4 | 0 | 9 | 0 |
| 7 | | 0.48 | 5 | 6 | 8 | 7 | 5 | 11 | 0 |
| 12 | | 0.52 | 0.76 | 8 | 3 | 6 | 0 | 12 | 0 |
| 61 | | 0.64 | 1.05 | 0.73 | ? | ? | ? | 5 | 0 |
| 45 | 0.56 | 0.76 | 1.03 | ? | 0.40 | 0 | 0 | 0 | 0 |
| 6 | | 0.79 | 1.00 | ? | 0.41 | 0.54 | 0 | 0 | 0 |
| 8 | 0.53 | 0.64 | 1.28 | ? | 0.35 | 0.49 | 0.46 | 0 | 0 |
| 9 | | 1.35 | 1.46 | 1.13 | 0.76 | 0.81 | 1.35 | 1.09 | 0 |
| X | 0.48 | 0.45 | 0.57 | 0.36 | 0.17 | 0.33 | 0.20 | 0.70 | 0 |

Gray numbers denote activity - increase in glucose release compared to NegCont (CBHs + EE), g/l (EG couple activity minus NC);
Black numbers - Synergy - increase in glucose release compared to the more active component of the couple, % (100% * EG couple act. divided by EG max act. minus 100%).
A - 27 h time-point;
B - 48 h time-point.

TABLE 14

Data analysis of experiment with different EG combinations (see FIGS. 28 and Table 13).

| | Activity | | | | Synergy | | | |
|---|---|---|---|---|---|---|---|---|
| | 27 hrs | | 48 hrs | | 27 hrs | | 48 hrs | |
| Rang # | EG couple GH/GH | Activity g/l | EG couple GH/GH | Activity g/l | EG couple GH/GH | Synergy % | EG couple GH/GH | Synergy % |
| 1 | 5/9 | 1.09 | 9/12 | 1.40 | 5/9 | 28 | 9/12 | 12 |
| 2 | 5/X | 0.95 | 9/7 | 1.35 | 8/X | 21 | 9/7 | 11 |
| 3 | 9/7 | 0.82 | 9/5 | 1.27 | 6/8 | 18 | 9/5 | 9 |
| 4 | 9/61 | 0.82 | 9/61 | 1.13 | 7/12 | 17 | 7/45 | 8 |
| 5 | 7/12 | 0.79 | 5/12 | 1.09 | X/8 | 17 | 61/12 | 8 |
| 6 | 7/X | 0.79 | 61/12 | 1.05 | 7/X | 16 | 5/12 | 7 |
| 7 | 9/12 | 0.67 | 6/12 | 1.00 | 9/7 | 15 | 7/6 | 7 |
| 8 | 61/12 | 0.65 | 6/5 | 1.00 | 9/61 | 15 | 7/61 | 6 |
| 9 | 12/45 | 0.65 | 7/5 | 1.00 | 45/8 | 14 | 12/6 | 6 |
| 10 | | | | | 12/45 | 13 | 7/12 | 5 |
| 11 | | | | | 61/12 | 12 | 7/8 | 5 |
| 12 | | | | | 9/12 | 10 | 9/61 | 5 |

In this Table the best performing EG pairs based on activity and synergy data from Table 13 listed in the order of performance starting with the best pairs. Four groups of the best performers were formed for two different parameters (activity and synergy) and for two different time-points: 27 and 48 hrs. The pairs highlighted green are the pairs that present in all 4 groups.

Example 14

Testing of Higher EG Combinations for Enhanced PHW Activity

Figure 30:
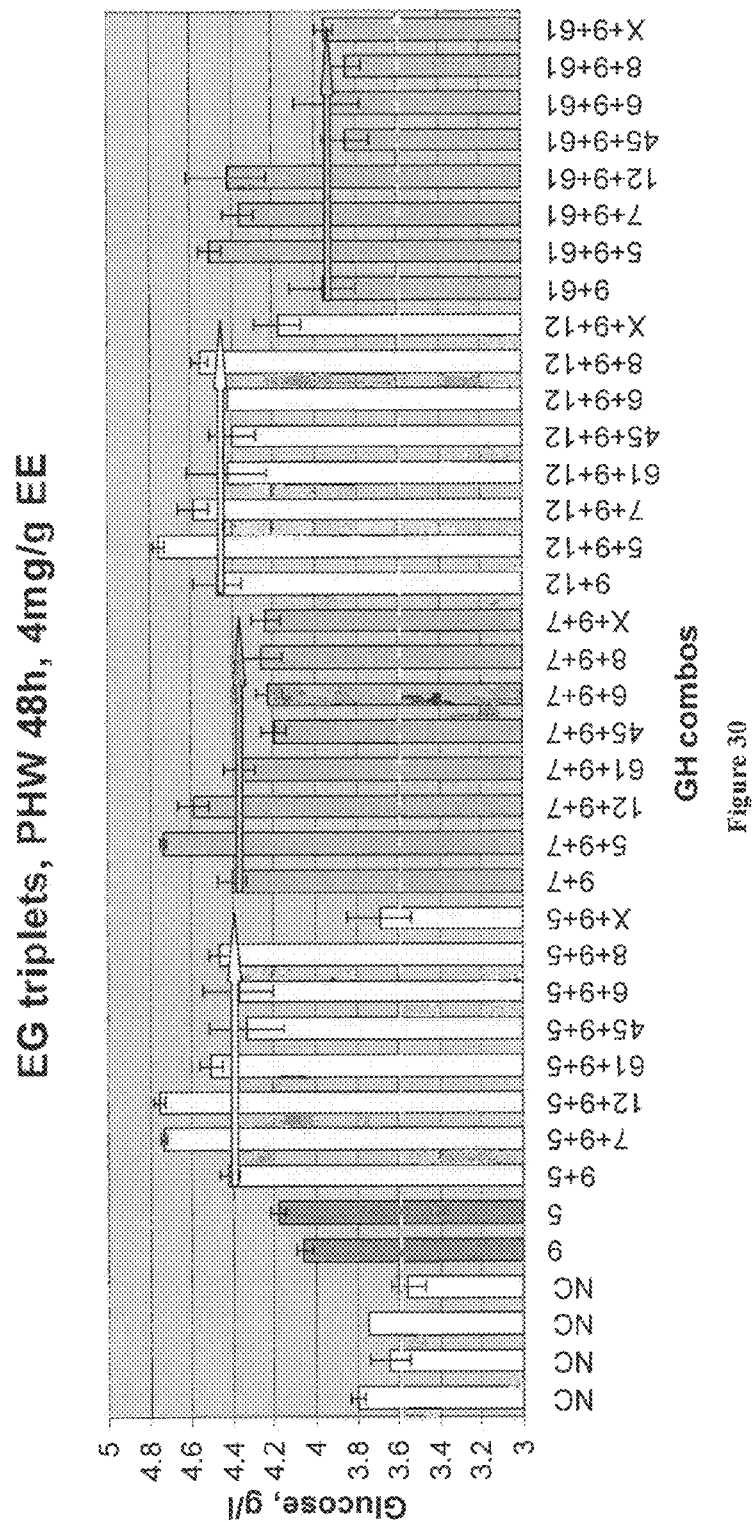
FIG. 30 depicts results from an assay measuring glucose release from PHW provided by different combinations (triplets) of EGs that belong to different GH families. Glucose was measured by GHK kit. The samples were taken at 48 hrs. The sample numbers are GHF numbers (see Tables below). The negative control (NC—empty vector) and other single EGs supernatants were added in amount of 2 ml. In samples with two EGs, 1 ml of each supernatant was added. In samples with three EGs 0.666 ml of each supernatant was added. All samples including NC were supplemented with 1 mg/g CBH1+1 mg/gCBH2+4 mg/g EE. MS630 was used as substrate (a pretreated hardwood). All experiments were performed in triplicate. The bar without error bars had two repeats fail.
Figure 31A:
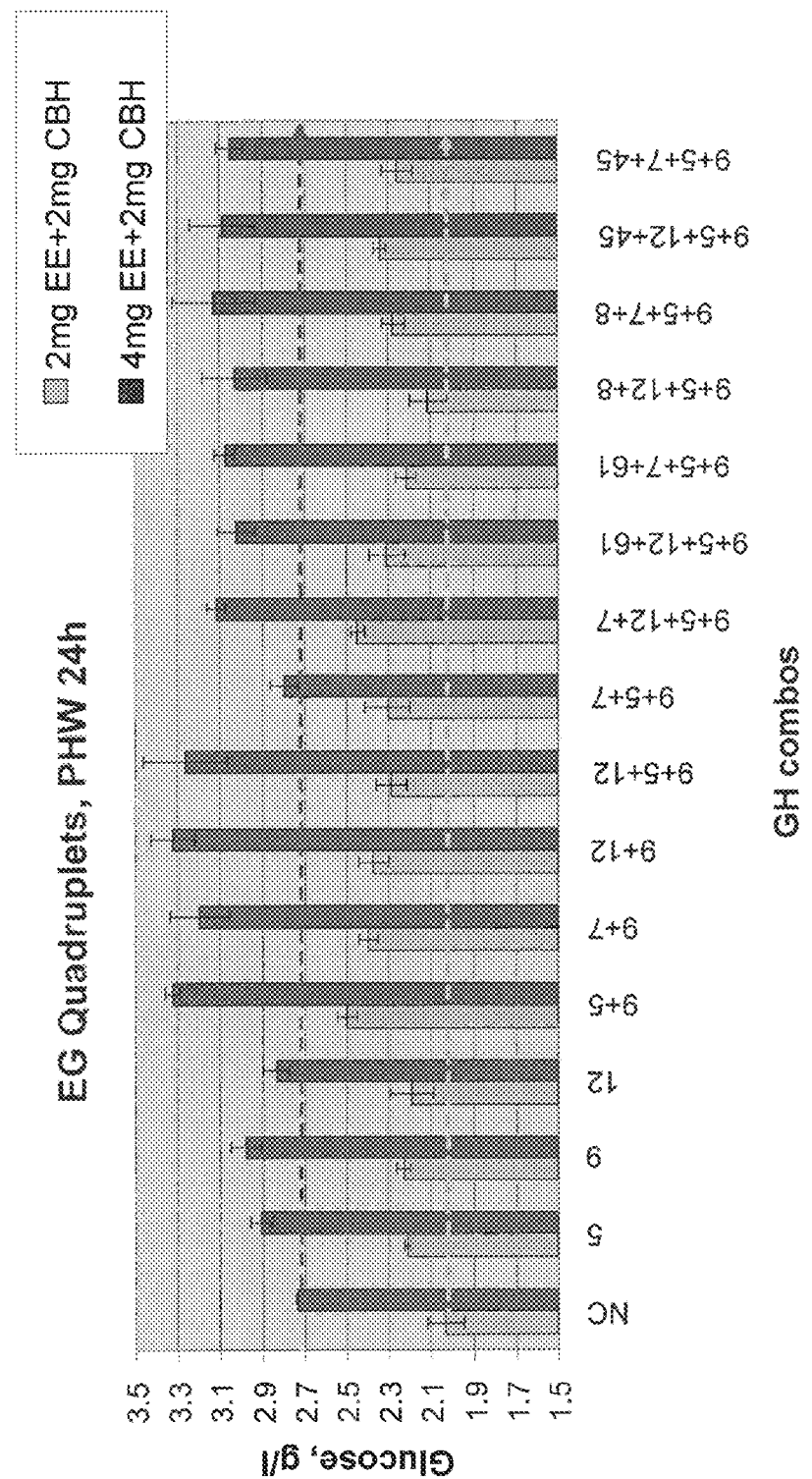
FIG. 31A, FIG. 31B, FIG. 31C and FIG. 31D depict results from an assay measuring glucose release from PHW provided by different combinations of EGs that belong to different GH families. Glucose was measured by a glucohexokinase kit. The samples were taken at 24 (A), 48 (B), 72 (C) and 96 (D) hrs. The sample numbers are GHF numbers (see Tables). The negative control (NC—empty vector) and other single EGs supernatants were added in amount of 2 ml. In samples with two EGs 1 ml of each supernatant was added. In samples with three EGs 0.666 ml of each supernatant was added. In samples with four EGs 0.5 ml of each supernatant was added. All samples including NC were supplemented with 1 mg/g CBH1+1 mg/gCBH2+EE (EE composition, see above). EE was added at 2 mg/g TS (blue bars) or 4 mg/g TS (purple bars). All experiments were performed in triplicate.
Figure 31B:
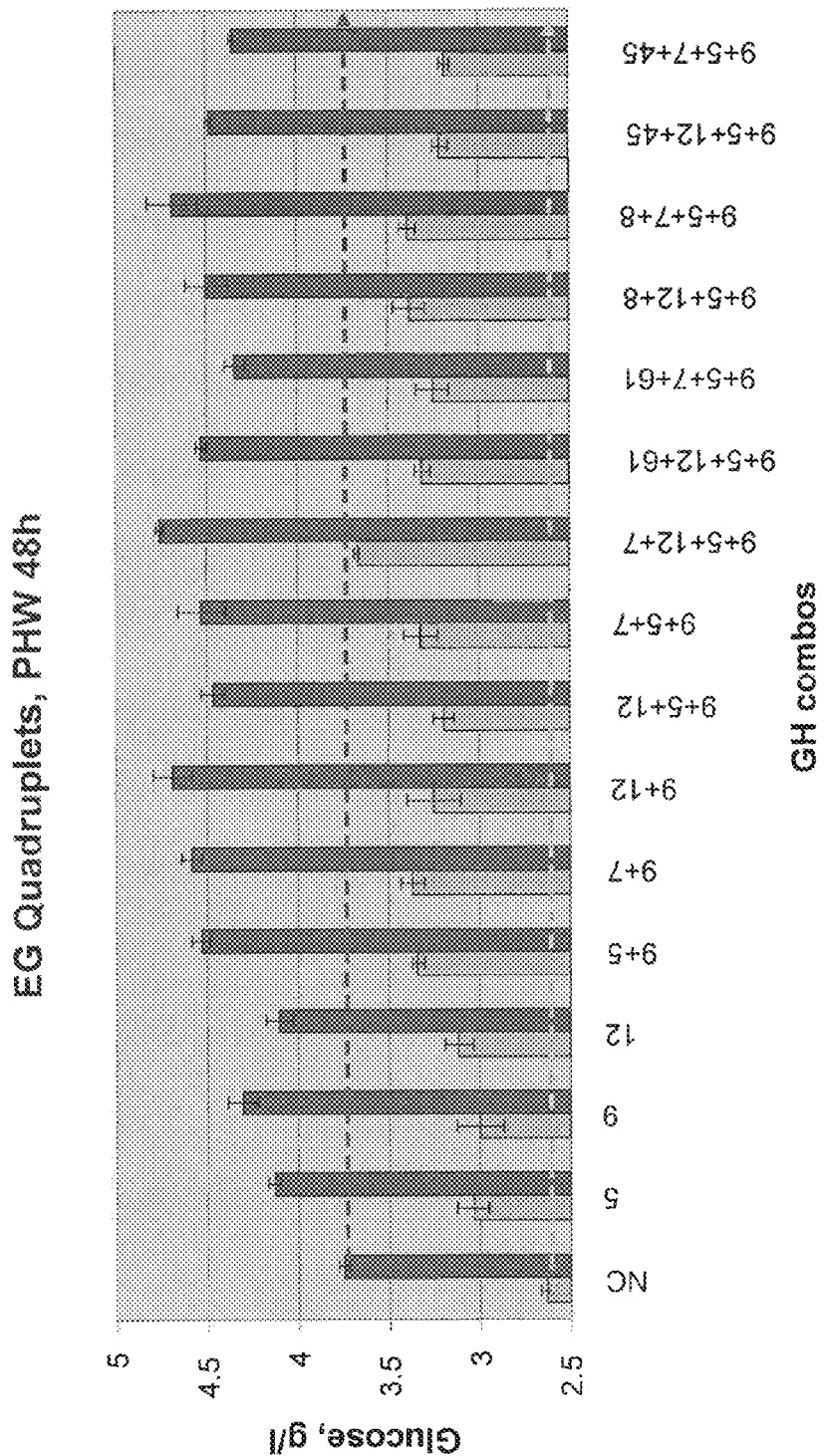
Figure 31C:
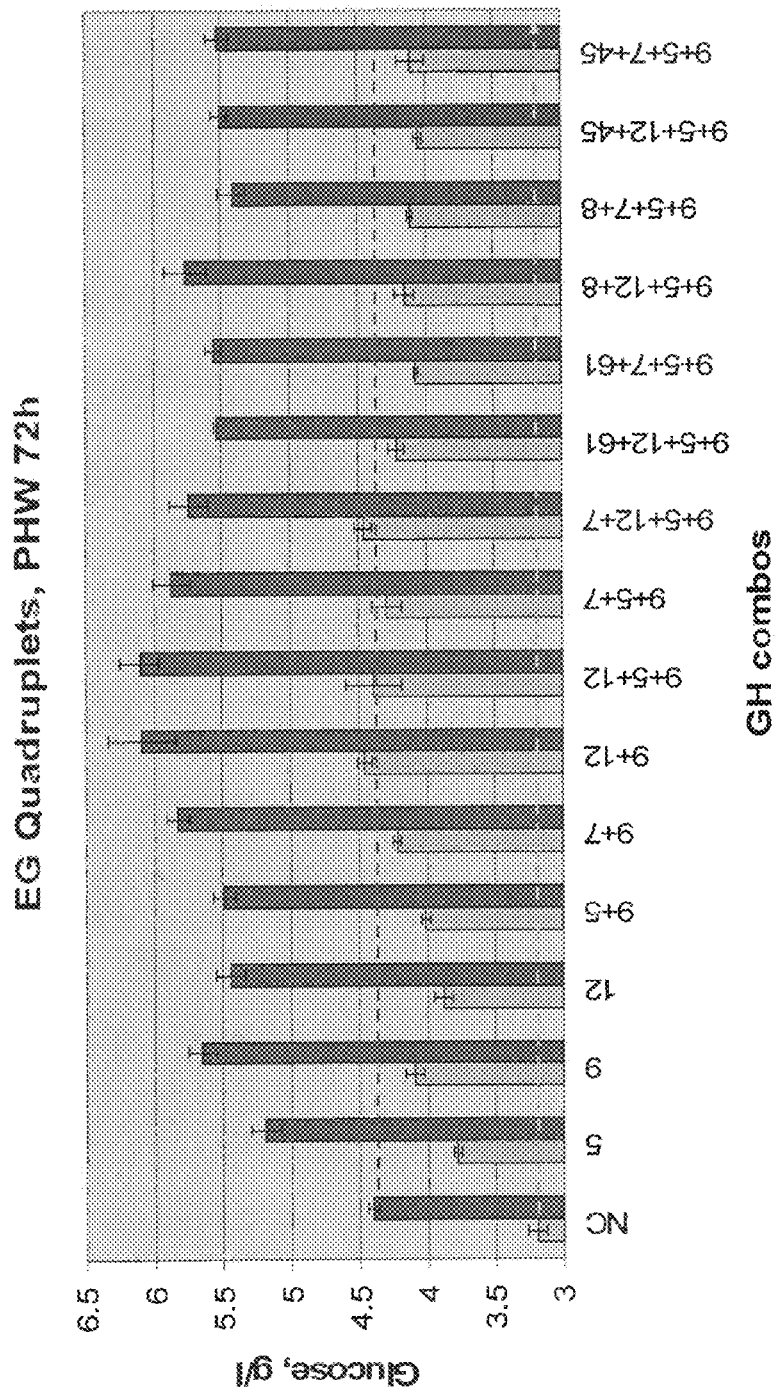
Figure 31D:
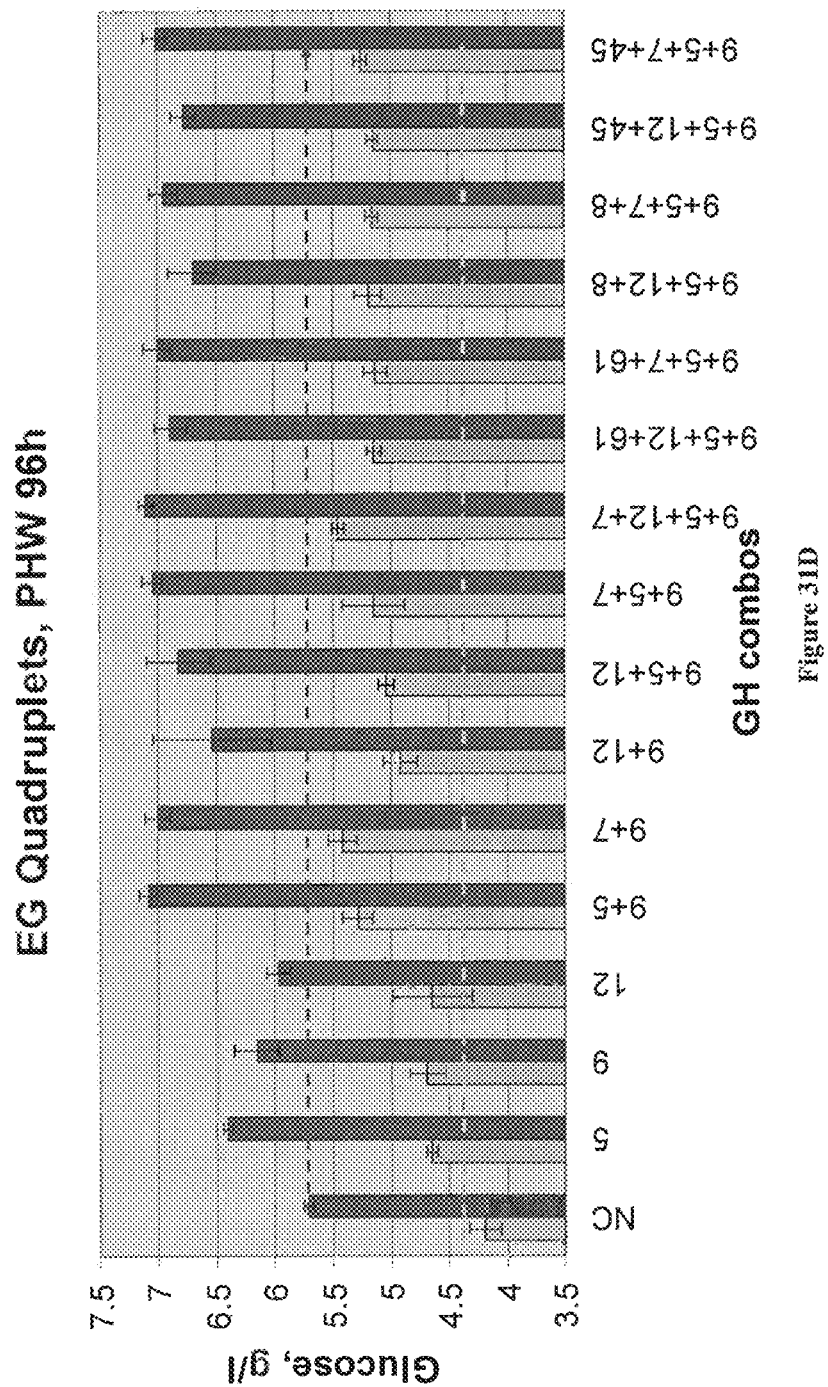

Based on the EG pair screening above, an experiment was designed in which the most efficient EG pairs were combined with each of the remaining EGs from Table 14. The PHW assay was performed with all possible triple EG combinations at the presence of external enzymes (EE, see composition above) and yeast made CBHs (FIG. 30). The total assay volume was divided into 3 parts for the triples (0.67 mL each), whereas it was divided into only 2 or 1 part for the pair and single controls, respectively.

FIG. 30 demonstrates that yeast cellulytic system, when used with EE, does benefit from more complex EG compositions. Based on 48 hrs data two best EG triplets were selected for further experiments: GH9+GH5+GH12 and GH9+GH5+GH7.

The best triplets were combined with each of the remaining EGs and the PHW assay was repeated again at two different concentrations of EE (FIG. 31). FIG. 31 demonstrates that:
1. EG combinations have a definite advantage in PHW glycan conversion compared to single EGs.
2. Which EG combination is the best depends on the EE load and time of conversion.
3. At all times and EE loads tested the best EG combos include: Cel9A(GH9), EG3(GH12), EG1(GH7) and EG2 (GH5).
4. At lower EE loadings, the combination of GH5, GH9, GH7, and GH12 appears the best.

The data for the best single EGs (GH9 and GH5) and the best four EGs together (GH9, GH5, GH12, GH7) were plotted as a time course of PHW conversion at the presence 2 mg/g EE next to the controls—2 mg/g and 4 mg/g EE without EGs added (supernatant of empty vector added instead) (FIG. 32). FIG. 32 demonstrates that the four EG combination has a definite advantage over the best single EGs at the same volume. Also, FIG. 32 demonstrates that the best EG combination provides increase in PHW conversion equivalent to 2 mg/g EE.

Example 15

Expression of a "Complete" System of Enzymatic Components to Digest Lignocellulose The technical challenge of developing a "complete" or mostly complete lignocellulolytic enzyme system for expression in yeast, is that this system is likely to consist of many components. These components will need to be expressed in multiple copies in order to generate enough activity to be meaningful. Thus, developing tools for multi-gene, multi-copy expression are very useful in this context.
Transferable System for Expressing Multiple Genes in Multiple Copies Expressing multiple copies of the ~25 gene types listed in Table 4, in addition to the "core" enzymes (CBH1, CBH2, EG2, and BGL) already produced in yeast, will require new molecular tools. Repeated integration with marker removal will be labor intensive. In addition to this, a system that would make the enzyme system transferable between strains would extremely valuable since new hosts are continually being created.

Expressing large pieces of DNA is a solution to the problem outlined above. Among the options for expressing large pieces of DNA are CEN based plasmids and Yeast artificial chromosomes (YACs). "CEN" refers to centromeric, and CEN elements allow high fidelity dispersion of genetic elements into mother and daughter cells during cell division. First developed in 1987 (Burke D T, Carle G F, Olson M V, "," *Science.* 1987 May 15; 236(4803):806-12), YACs have been used for cloning very large pieces of DNA for expression in non-yeast hosts (e.g. in mice; Schedl, 1993), and for genome sequencing (e.g. Krzywinski M, Wallis J. Gösele C, et al., "Integrated and sequence-ordered BAC- and YAC-based physical maps for the rat genome," *Genome Res.* 2004 April; 14(4):766-79). They are able to maintain up to 3 megabases of DNA. Of particular interest for our project, YACs have been developed whose copy number can be amplified (Smith D R, Smyth A P, Moir D T., "Amplification of large artificial chromosomes," *Proc Natl Acad Sci USA.* 1990 November; 87(21): 8242-6). This is based on disrupting CEN function, and selecting for cells with asymmetric segregation of the YAC. The authors showed that the system developed could increase the copy number of a 560 Kb YAC to 13 copies, and of 120 Kb YAC to 20 copies. After 20 generations the 560 Kb YAC had fallen to 8.2 copies, and the 120 Kb YAC had fallen to 11.3 copies. These results indicate that even these very large DNA fragments, with no, or little selective benefit to the cell can be maintained with decent stability. The copy number feature for YACs was originally created in CEN plasmids (Chlebowicz-Sledziewska E, Sledziewski A Z., "Construction of multicopy yeast plasmids with regulated centromere function," *Gene.* 1985; 39(1):25-31), and these plasmids are likely the easiest option for expressing the ~20 kb piece of DNA that would comprise the "major" activities. In addition to these features, researchers (Spencer F, Simchen G. "Transfer of YAC clones to new yeast hosts," *Methods Mol Biol.* 1996; 54:239-52) have shown that YACs can be transferred from one yeast host to another, as well as being modified by homologous recombination.

For enzymes that are deemed necessary in only a single, or double copy—"minor" components—a single large integrative construct can be built, which will save the effort of producing a large CEN plasmid, and create a more stable system.

Example 16

Assembly of Large Vectors for Expression of Multiple Genes

Assembly of genes into large constructs by homologous recombination is well known in *S. cerevisiae* (Shao Z, Zhao H, Zhao H., "DNA assembler, an in vivo genetic method for rapid construction of biochemical pathways," *Nucleic Acids Res.* 2009 February; 37(2):e16. Epub 2008 Dec. 12)(Oldenburg K R, Vo K T, Michaelis S, Paddon C., "Recombination-mediated PCR-directed plasmid construction in vivo in yeast," *Nucleic Acids Res.* 1997 Jan. 15; 25(2):451-2). This represents a tool for both routine cloning and for combining many genetic elements at once. Using the enzymes tested above, we were able to assemble large CEN constructs for expression of multiple genes in multiple copies. These vectors were constructed with one of two markers (hph or zeocin marker), with the ARS1 origin of replication from *S. cerevisiae*, with a disruptable centromere (CEN 4), and with a 2 micron element present. This disruptable element was made by placing the inducible Gal1 promoter upstream of the centromere. During growth on galactose, the plasmid becomes unstable.

Figure 33:
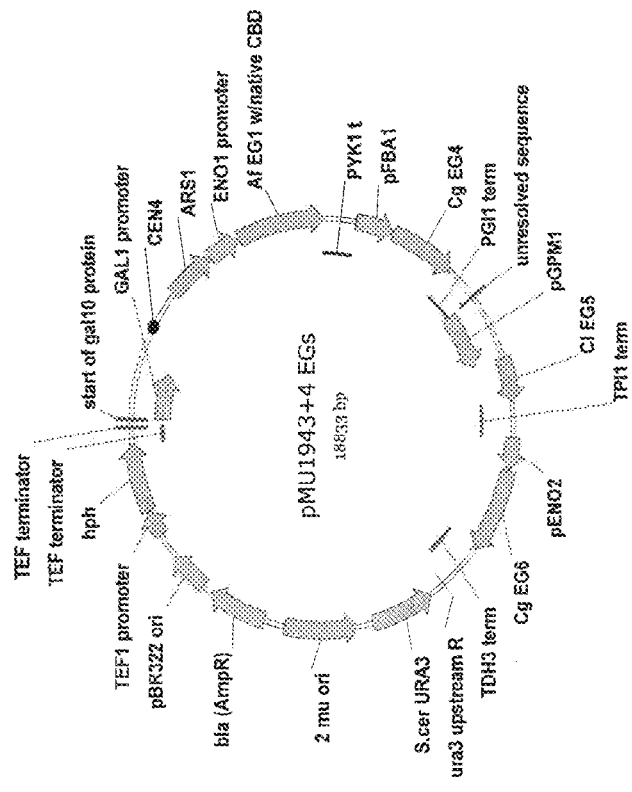
FIG. 33 depicts a CEN vector with a Gal promoter upstream of the centromere and an ARS replication origin (another 2μ origin is also present to fire replication at multiple points for large vectors). The four endoglucanases have unique promoters driving them. The promoter/EG/terminator cassettes were PCR amplified from existing vectors and incorporated into NotI digested pMU1943. The right hand panel shows the activity of 6 separate colonies picked from the YML transformation plate, which all demonstrated EG activity.

FIG. 33 demonstrates the ability to assemble four endoglucanases simultaneously into a single vector (EG1 from *A. fumigatus* under the control of the ENO1 promoter/PYK terminator, EG4 from *C. globosum* under the control of the FBA promoter/PGI terminator. EG5 from *C. lucknowense* under control of the GPM1 promoter and TPI terminator, and EG6 from *C. globosum* under control of the ENO2 promoter and TDH3 terminator). Each cassette for expression was amplified by PCR with overlapping sequences that could recombine to form the final vector shown (actual vector is circular, not linear). Several colonies picked from this transformation all had activity on CMC, indicating that the EGs were functionally expressed. The construct (pMU1943) was verified by carrying out PCR across all of the junctions of the individual pieces that were assembled. The yeast strain containing this cassette was called M1509.

As outlined above, a similar CEN vector and strain were created with the zeocin marker (pMU1666). EG1, EG4, EG5 and EG6 were successfully assembled by YML into CEN vectors with the zeocin marker (strain M1553). PCR tests were done to confirm the junctions between EG cassettes and between vector and cassettes for the first (EG1) and last (EG4) cassettes.

Figure 34A:
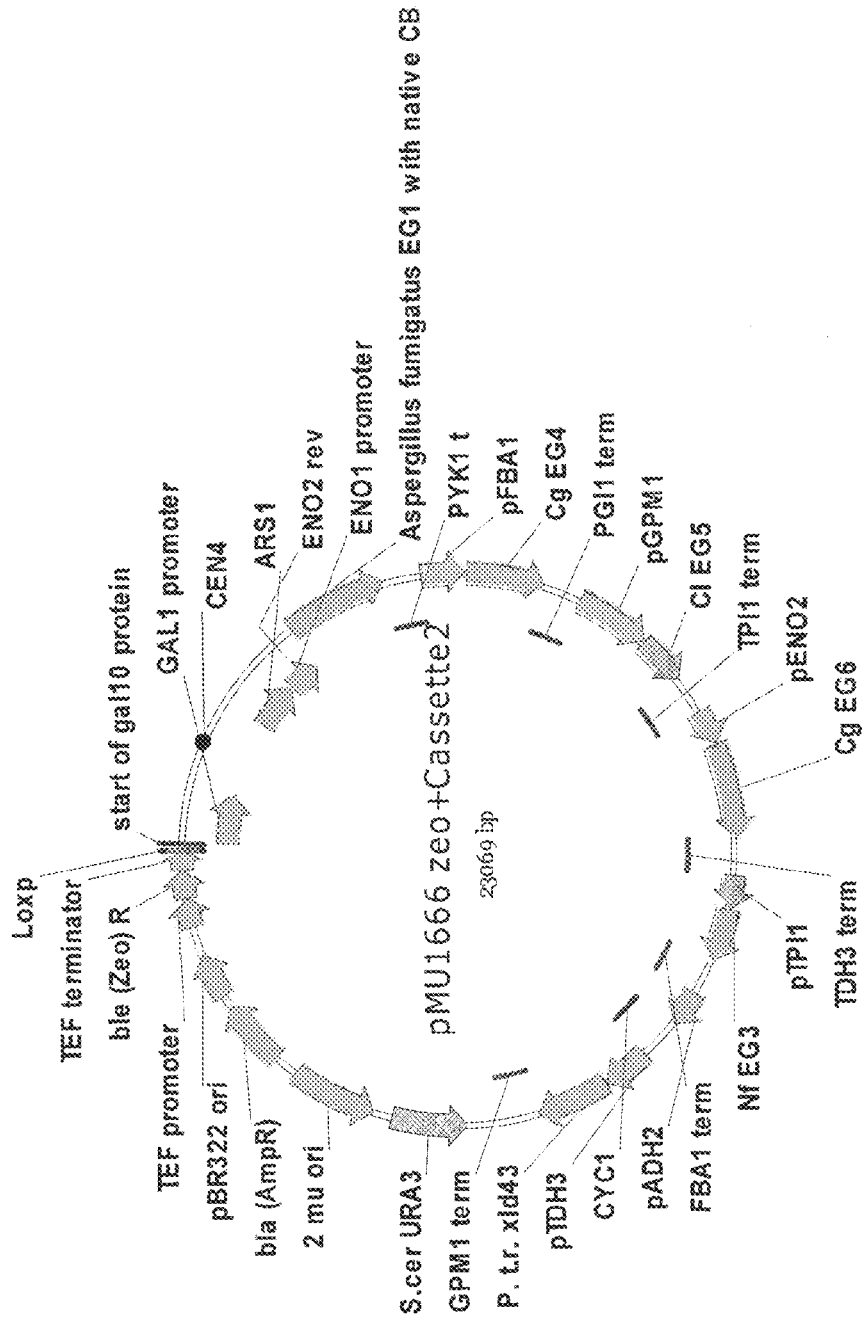
FIG. 34A and FIG. 34B depict CEN vectors built for testing the ability to assemble large constructs. M1634 contains the CEN with 7 genes (23 kB), and M1635 contains the CEN with 11 genes (M1635).
Figure 34B:
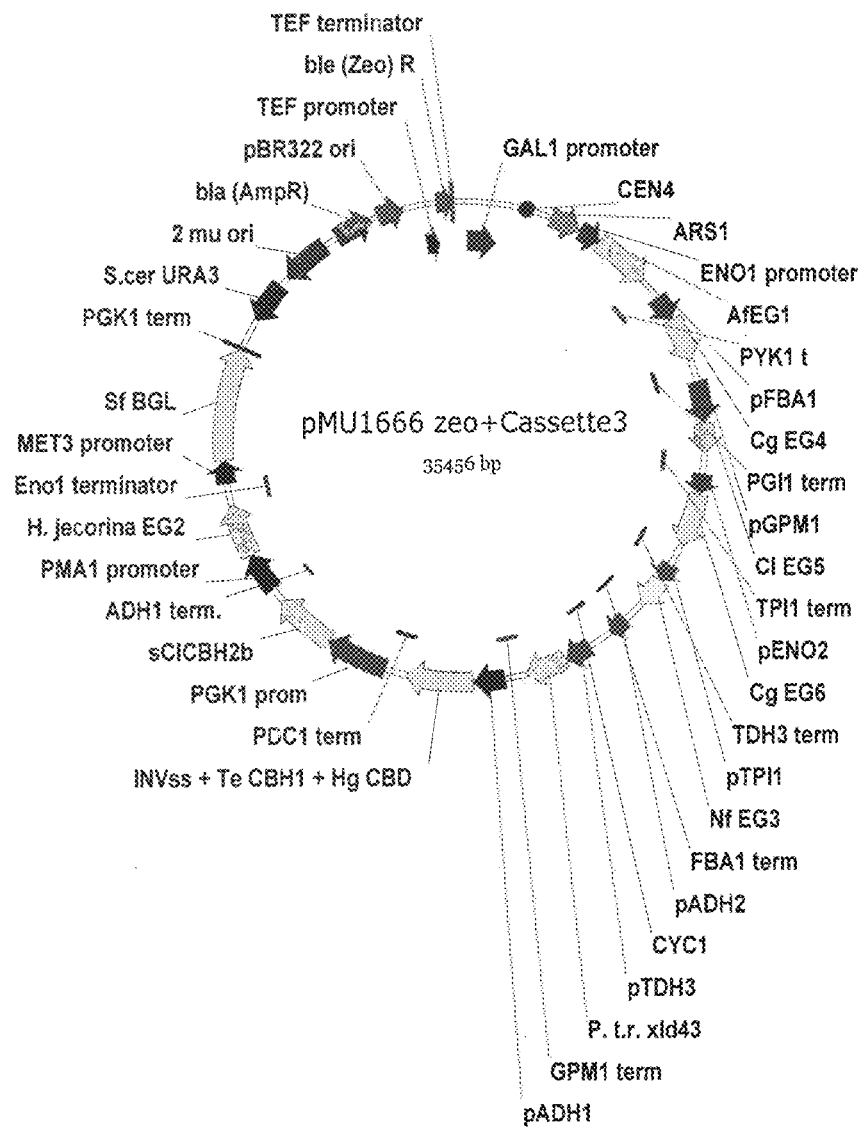

CEN vectors were also built that had either 7 genes or 11 genes via yeast mediated ligation. Schematics for these two vectors are shown in FIG. 34. These vectors were tested to verify the presence of the inserts via PCR. The two vectors below demonstrate that vectors as large as 23 kB and 35 kB, respectively can be generated in this manner.

Example 17

Amplification of CEN Vectors for Multicopy Expression

Figure 35:
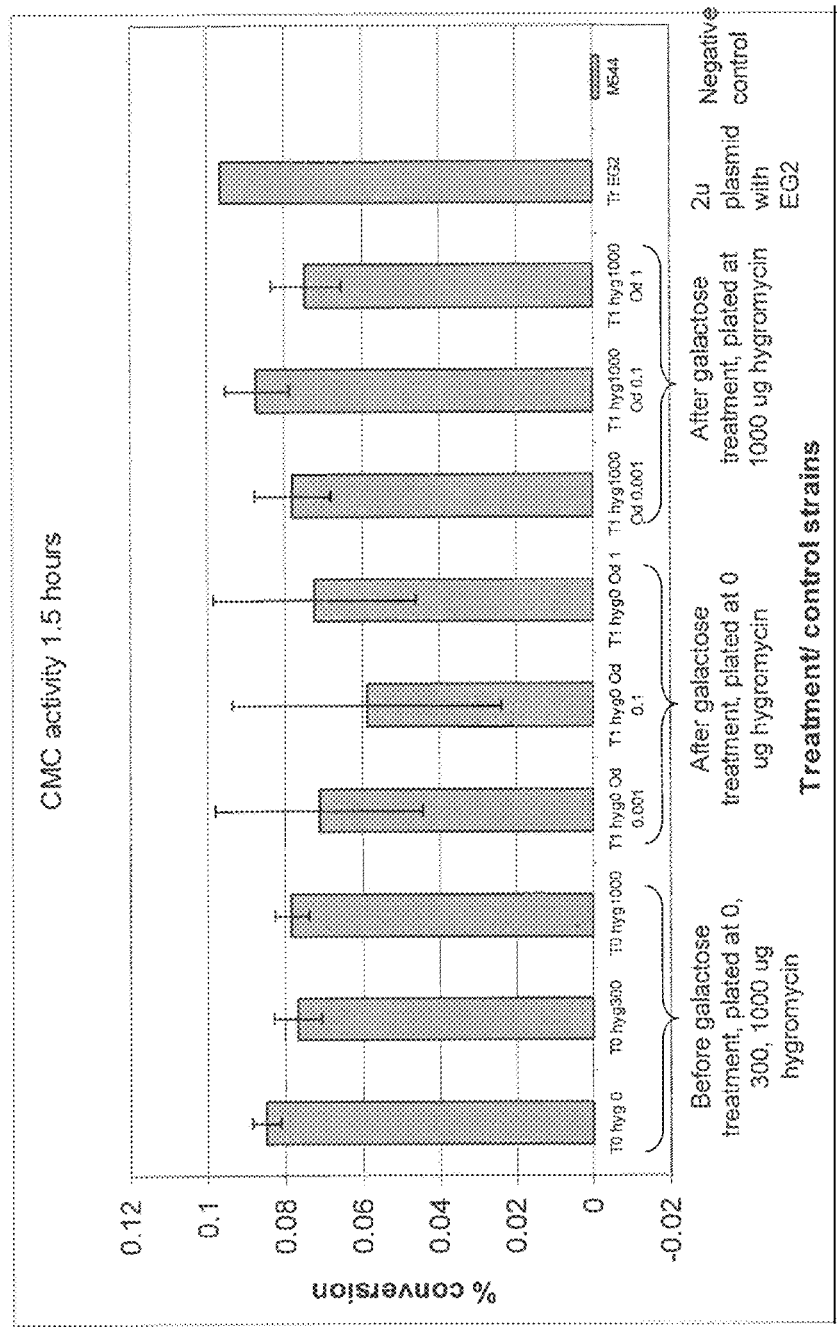
FIG. 35 depicts results from an assay measuring CMC activity for colonies picked from selective and non-selective plates after growth of the starting culture in YPD or YP-Galactose. Activity is comparable before and after galactose treatment in colonies from high antibiotic resistance plates. Colonies treated with galactose and plated on YPD without hygromycin show a large variation as seen from the error bars indicating that the CEN vector is functioning as expected during galactose growth.

Strain M1509 produced very few slow-growing colonies at T0 at a hygromycin concentration of 1000 µg/ml. After growth in YP+galactose, there was an increased number of colonies on hygromcin 1000. These colonies also grew faster on YPD+hygromycin 1000 than colonies before the galactose treatment. This suggested that the copy number may have increased with the galactose treatment allowing faster growth and more colonies on the high hygromycin concentration plate. However, a CMC assay revealed that the endoglucanase activity both before and after the galactose treatment remained almost the same (FIG. 35).

Figure 36:
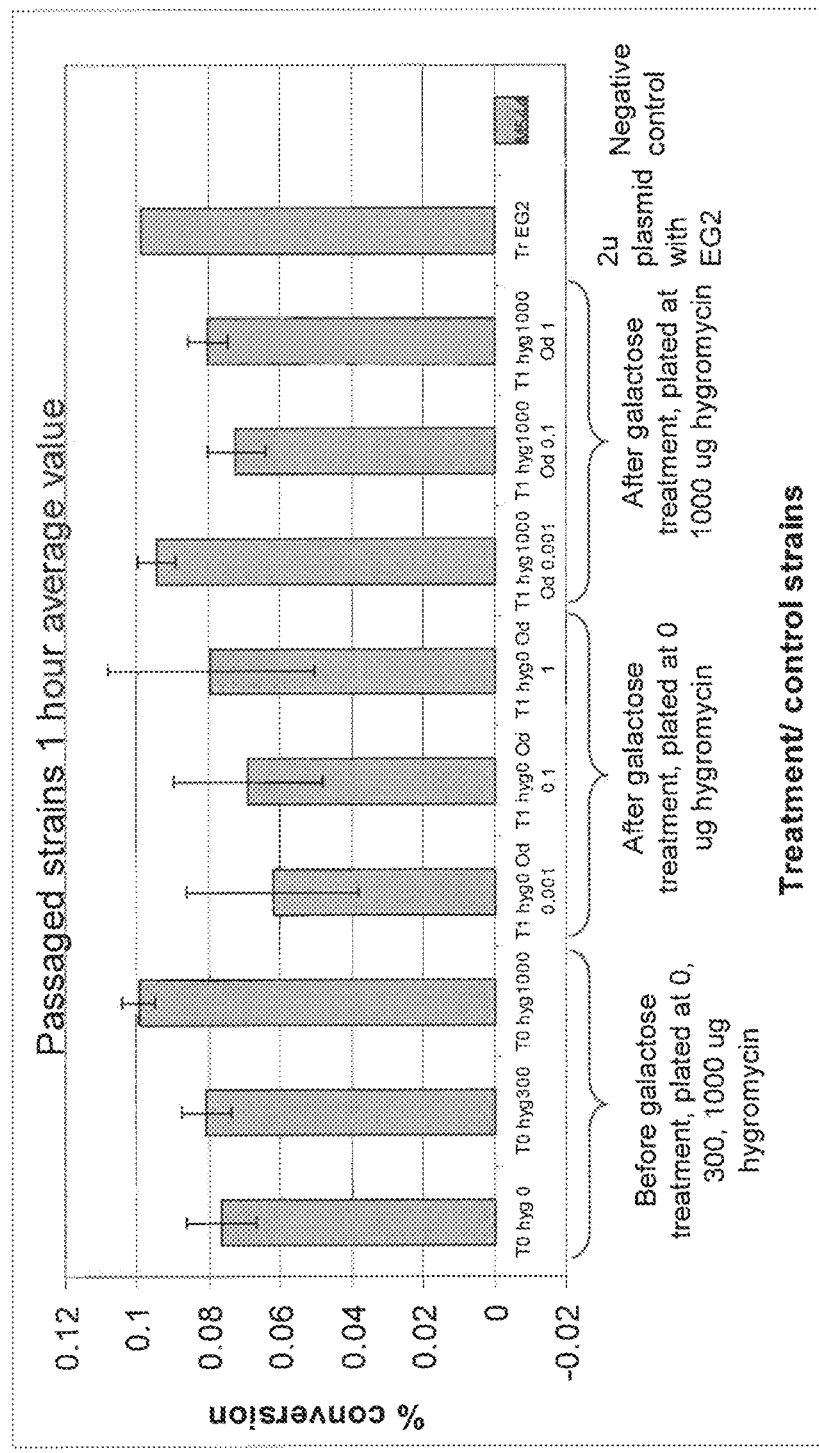
FIG. 36 depicts results from a CMC assay on strains expressing CEN6 vector passaged twice (about 10 generations) in YPD without antibiotic. The CMC activity is comparable after passaging for about 10 generations in YPD without antibiotic. It should be noted that FIG. 35 shows the CMC assay data after only an hour, whereas the CMC assay before passaging the strains is for a 1.5 hour time point.

Outgrowth was also done in YPD without antibiotic for about 10 generations and the CMC activity before and after the outgrowth remained fairly similar indicating the stability of the plasmid (FIG. 36). Another interesting feature was that colonies from YPD plate (no selection) after a galactose growth treatment showed variable CMC activity, with some colonies having a large decrease in activity (indicated by a very high standard deviations in FIG. 35). This indicates that the CEN vector was working as expected in presence of galactose causing some cells to retain more copies of plasmid and others to lose it.

As noted above, M1553 is a strain containing a CEN vector with the zeocin resistance cassette and four endoglucanases EG1, EG4. EG5 and EG6. This strain was tested for antibiotic resistance and EG activity. Initially M1553 could grow up to a zeocin concentration of 50 µg/ml in YPD plates, and this strain passaged in YPG (galactose) and zeocin at 50 µg/ml showed colonies when plated on YPD plates with zeocin at 100 µg/m. These zeocin (100)-resistant colonies also grew on YPD-zeo 500 ug/mL plates when re-streaked. Ten colonies from the YPD-zeo 100 ug/mL plate were compared against ten original CEN strain colonies grown on YPD-zeo 50 ug/mL. Serial dilutions 1:5, 1:10, 1:20 and 1:40 were made from culture supernatants and a CMC assay was carried out on the diluted supernatants.

Figure 37:
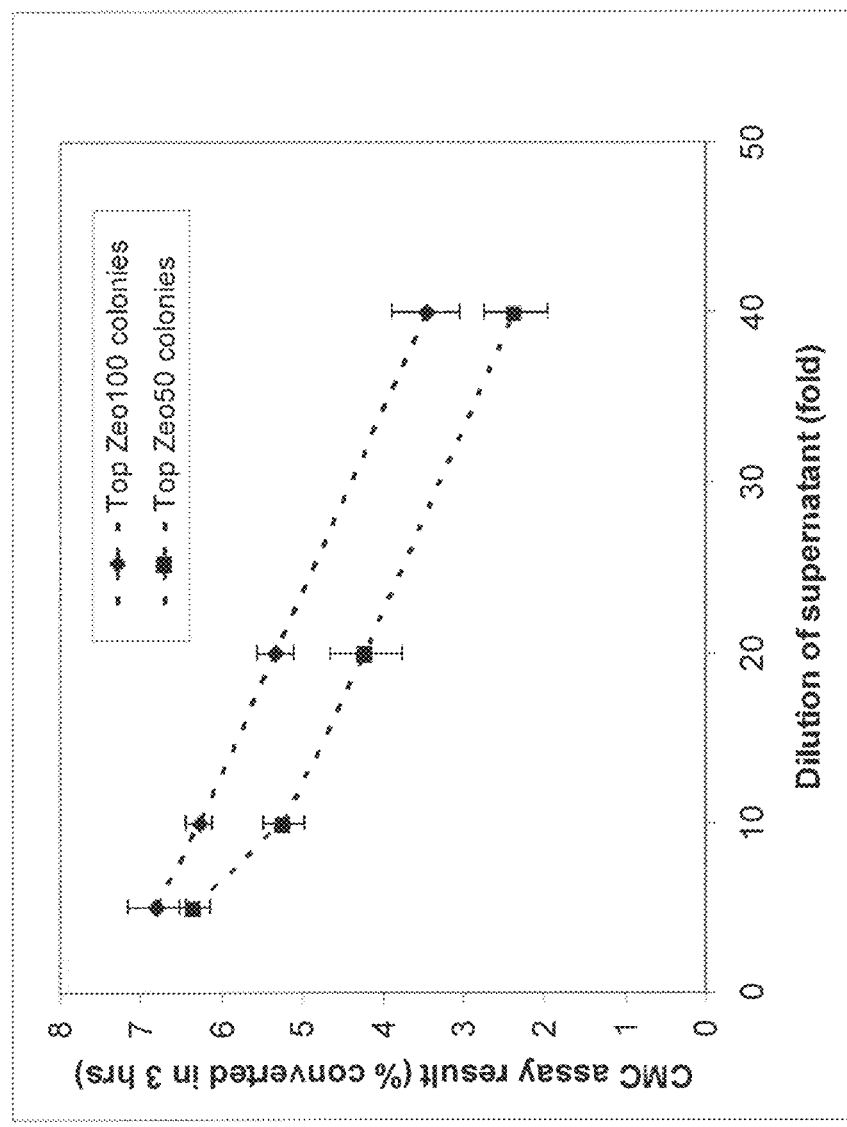
FIG. 37 depicts an assay which is a comparison between the top-performing colonies from YPD/zeocin (100) and YPD/zeocin (50) plates at various dilutions.

FIG. 37 shows a comparison of the average performance of the top 3 colonies from each of these plates at the different dilutions. Colonies from the 100 ug/mL zeocin plate perform better than the zeocin 50 ug/mL colonies indicating that amplification of the CEN vector has occurred. Depending on the dilution analyzed (the CMC assay appears to be at saturation in some dilutions), a 1.5 to 2× difference in CMCase activity can be observed between the two sets of top colonies.

This demonstrates that growth in galactose to disrupt CEN function coupled with selection via the zeocin marker can result in vector amplification.

Example 18

Activity of a CEN Vector with Multiple EGs on PHW

Figure 38:
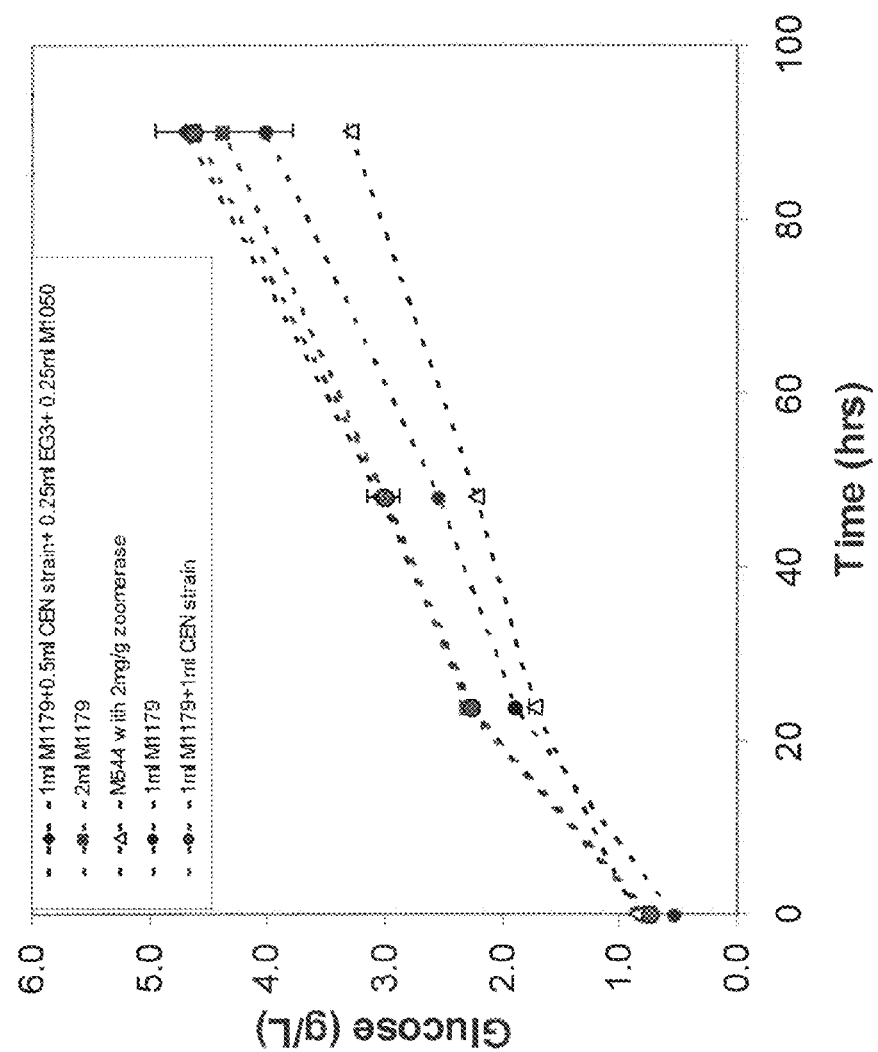
FIG. 38 depicts results from a PHW assay with yeast produced enzymes alone. M11179 (Strain with core cellulases CBH1/CBH2/EG2/BGL1) was used along with CEN strain expressing 4 EGs (EG1, 4, 5 and 6) strain M1377 (EG3) and M1050 (cel9A).

A CEN vector with the zeocin resistance marker expressing the *A. fumigatus* EG1, *C. globosum* EG4, *C. lucknowense* EG5, and *C. globosum* EG6 from different promoters and terminators was created in M0544 as described above. This vector was tested for its effect on PHW hydrolysis in an unamplified state along with strains expressing EG3 and Cel9A from 2 micron vectors (FIG. 38). The results indicate that a 2× loading of a strain producing high levels of the core enzymes (M1179) is equivalent to a 1× loading of M1179 plus a 1× loading of the CEN vector strain (or to a 1× loading of M1179 and a mixture of the CEN strain, EG3, and Cel9A).

Example 19

Screening of Amylolytic Enzymes for Expression in Yeast

Figure 41:
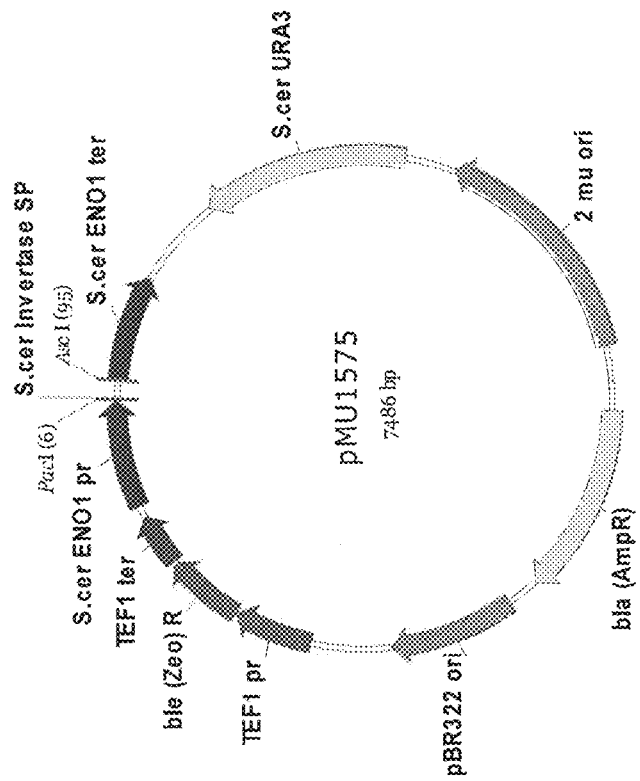
FIG. 41 depicts a map of the episomal 2-μ yeast expression vector used for expression of genes from Tables 15-17. S.cer ENO1 pr—*S. cerevisiae* ENO1 promoter; S.cer Invertase SP—*S. cerevisiae* Invertase signal peptide; S.ser ENO1 ter—*S. cerevisiae* ENO1 terminator; S.cer. URA3—*S. cerevisiae* URA3 auxotrophic marker; 2 mu ori—2μ *S. cerevisiae* plasmid origin of replication; bla(AmpR)—Amp resistance marker; pBR322—*E. coli* pB322 plasmid origin of replication; TEF1 pr—*Ashbya gossypii* TEF1 promoter; TEF1 ter—*A. gossypii* TEF1 terminator; ble (Zeo) R—*Streptoallotei-chus hindustanus* ble Zeocin resistance gene.

Over one hundred amylolytic, cellulolytic, and accessory enzymes from yeast, fungi, bacteria and plants were screened for functional expression in yeast. Most of the enzymes that were selected for screening are summarized in Tables 15 and 16. The bacterial enzymes marked "BC" are described in Table 7. The enzymes from Tables 15 and 16 were expressed in yeast and screened by multiple assays individually or in combinations. Table 15 includes 67 genes (first 10 overlap with Table 16). For 32 genes functional expression in yeast was confirmed (marked gray). Table 16 contains 81 genes; for 18 genes functional expression in yeast was confirmed (gray). The information about gene sequences was obtained from NCBI database or from proprietary Mascoma genome sequencing data (marked * in the Table 16). The genes were either synthesized (GeneArt or DNA2.0) or PCR amplified. Synthetic genes were either native DNA sequences or codon optimized for *S. cerevisiae*. When PCR was used to obtain genes, either genomic DNA or cDNA was used as template. The genes used are described in the Tables 15, 16, or Table 7. The sequences of the important genes used for construction of CBP strains are listed in Table 19. The genes were expressed under ENO1 promoter and terminator from 2-micron plasmid pMU1575 (FIG. 41). The genes were inserted between PacI/

Figure 42:
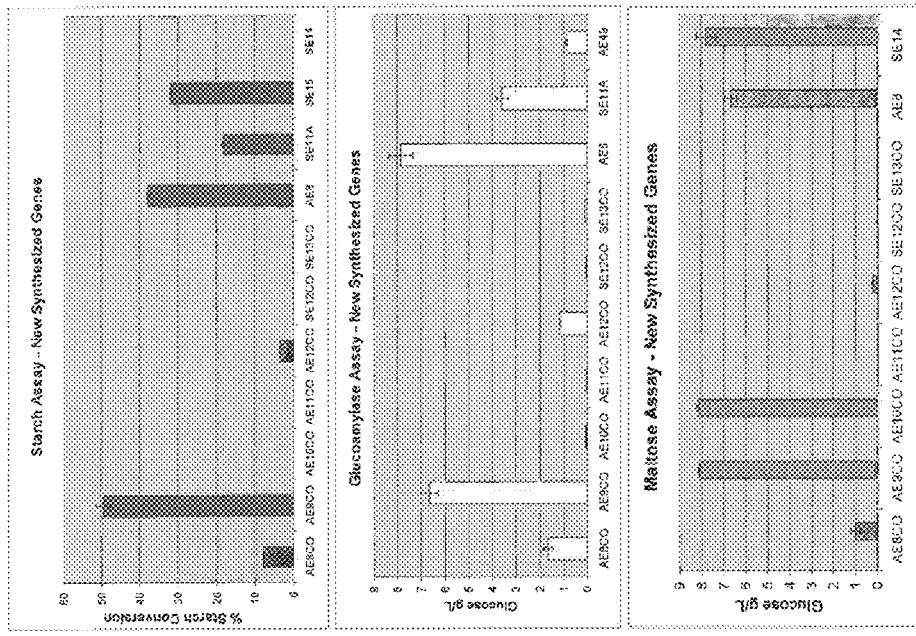
FIG. 42 depicts secreted activity of strains expressing new synthetic genes measured by Starch-DNS (top), Starch-GHK (middle), and Maltose (bottom) assays. All genes are described in Tables 15 and 16. All genes were inserted between PacI/AscI of pMU1575 2μ expression vector and transformed into M1744 strain. Transformants were grown in YPD for 3 days and supernatants were analyzed for activity. "CO"—codon optimized for yeast synthetic genes; others—PCRed from genomic DNA or cDNA.

AscI sites of pMU1575 either by cloning or yeast mediated ligation. Yeast and fungal genes were expressed with their native signal sequences. Bacterial genes (such as AE49) were attached to *S. cerevisiae* Invertase signal sequence. Expression constructs were transformed into an industrial background strain M1744, M509, or M0139 and selected on minimal URA deficient media. Transformants were grown in YPD for 3 days and supernatants were analyzed for activity. Data for the most active alpha-amylases (AA), glucoamylases (GA) and alpha-glucosidases (AGL) screened by starch-DNS, starch-GHK, maltose and Corn mash assays are summarized in Table 17. The example of screening of several enzymes for functional expression in yeast demonstrated on FIG. 42. Secreted activity of strains expressing synthetic genes was measured by Starch-DNS, Starch-GHK, and Maltose assays. FIG. 42 demonstrates that different enzymes have different activity on different substrates revealing different mechanisms of action.

TABLE 15

Amylolytic and other enzymes that were approved by FDA for feed and/or food use screened for functional expression in yeast. Grey boxes indicate enzymes that demonstrated functional expression in yeast.

| SE# | AE# | Organism | Source | Enzyme | Protein ID |
|---|---|---|---|---|---|
| 1 | 6 | Bacteria | *Bacillus subtilis* | Alpha-amylase | AAA22194.1 |
| 2 | 13 | Bacteria | *Bacillus subtilis* | Alpha-amylase | ACM91731.1 |
| 3 | 14 | Bacteria | *Bacillus subtilis* | Alpha-amylase | CAL64397.1 |
| 4 | 17 | Bacteria | *Bacillus subtilis* | Maltogenic alpha-amylase | AAF23874.1 |
| 5 | 15 | Bacteria | *Bacillus subtilis* | Pullulanase | AAC00283.1 |
| 6 | 16 | Bacteria | *Bacillus subtilis* | Isomaltase? | AAG23399.1 |
| 7 | 18 | Bacteria | *Bacillus subtilis* | Isomaltase? | BAA23408.1 |
| 8 | 19 | Bacteria | *Bacillus subtilis* | Isomaltase? | ZP_03592917.1 |
| 9 | 20 | Bacteria | *Bacillus subtilis* | Isomaltase? | BAA22245.1 |
| 10 | 2 | Yeast | *Saccharomyces cerevisiae* | Glucoamylase | AAA35107.1 |
| 11 | | Fungi | *Aspergillus niger* | Glucoamylase | AAP04499.1 |
| 12 | | Fungi | *Aspergillus oryzae* | Glucoamylase | BAA01540.1 |
| 13 | | Fungi | *Rhizopus oryzae* | Glucoamylase | BAA00033.1 |
| 14 | | Fungi | *Aspergillus niger* | Alpha-glucosidase | BAA23616.1 |
| 15 | | Bacteria | *Bacillus licheniformis* | Alpha-amylase | CAA01355.1 |
| 16 | | Bacteria | *Bacillus licheniformis* | Pullulanase | AAU24646.1 |
| 17 | | Bacteria | *Bacillus acidopullulyticus* | Pullulanase | ABE68909.1 |
| 18 | | Bacteria | *Bacillus subtilis* | Protease | ABJ99976.1 |
| 19 | | Bacteria | *Bacillus licheniformis* | Protease | AAZ77709.1 |
| 20 | | Fungi | *Aspergillus niger* | Beta-glucosidase | CAB75696.1 |
| 21 | | Fungi | *Talaromyces emersonii* | CBH1 | AAL89553 |
| 22 | | Fungi | *Trichoderma reesei* | CBH2 | AAA34210.1 |
| 23 | | Fungi | *Trichoderma longibrachiatum* | EG1 | AAA34212.1 |
| 24 | | Fungi | *Trichoderma reesei* | EG2 | ABA64553.1 |
| 25 | | Fungi | *Trichoderma reesei* | EG3 | BAA20140.1 |
| 26 | | Fungi | *Trichoderma reesei* | Xylanase | CAA49294.1 |
| 27 | | Fungi | *Aspergillus niger* | Xylosidase | CAK37179.1 |
| 28 | | Fungi | *Aspergillus niger* | Xylosidase/Arabinofuranosidase | CAK39870.1 |
| 29 | | Fungi | *Aspergillus niger* | Ferulic acid esterase | CAA70510.1 |
| 30 | | Fungi | *Aspergillus niger* | Alpha-amylase | CAA36967.1 |
| 31 | | Fungi | *Aspergillus niger* | Alpha-amylase | CAA36966.1 |
| 32 | | Fungi | *Aspergillus niger* | Xylanase | AAS46914.1 |
| 33 | | Fungi | *Aspergillus niger* | Xylanase | AAS46913.1 |
| 34 | | Fungi | *Aspergillus niger* | Xylanase | CAA03655.1 |
| 35 | | Fungi | *Aspergillus niger* | Isopullulanase | BAA19473.1 |

TABLE 15-continued

Amylolytic and other enzymes that were approved by FDA for feed and/or food use screened for functional expression in yeast. Grey boxes indicate enzymes that demonstrated functional expression in yeast.

| SE# | AE# | Organism | Source | Enzyme | Protein ID |
|---|---|---|---|---|---|
| 36 | | Fungi | *Aspergillus niger* | Alpha-amylase | XP_001402054.1 |
| 37 | | Fungi | *Aspergillus niger* | Endopolygalacturonase | XP_001389562.1 |
| 38 | | Fungi | *Aspergillus niger* | Pectinase | CAK42510.1 |
| 39 | | Fungi | *Aspergillus niger* | Arabinotaranosidase | CAK42333.1 |
| 40 | | Fungi | *Aspergillus niger* | Protease | XP_001401093.1 |
| 41 | | Plant | *Zea mays* | Pullulanase | NP_001104920.1 |
| 42 | | Plant | *Oryza sativa* | Pullulanase | ACY56113.1 |
| 43 | | Plant | *Zea mays* | Isoamylase | ACG43008.1 |
| 44 | | Fungi | *Aspergillus niger* | Lipase | ABG73613.1 |
| 45 | | Fungi | *Aspergillus niger* | Lipase | ABG73614.1 |
| 46 | | Bacteria | *Bacillus licheiliformis* | Xylanase | ABF61784.1 |
| 47 | | Fungi | *Humicola insolens* | Xylanase | CAA53632.1 |
| 48 | | Fungi | *Talaromyces emersonii* | Xylanase | CAD34597.1 |
| 49 | | Fungi | *Trichoderma viride* | Xylanase | AAQ67413.1 |
| 50 | | Plant | *Triticum aestivum* | Pullulanase | ABL84490.1 |
| 51 | | Yeast | *Saccharomyces cerevisiae* | Endopolygalacturonase | NP_012687.1 |
| 52 | | Yeast | *Kluyveromyces marxianus* | Endopolygalacturonase | AAR84199.1 |
| 53 | | Bacteria | *Bacillus subtilis* | Pectin lyase | NP_389746.1 |
| 54 | | Bacteria | *Bacillus licheniformis* | Polygalacturonase | YP_080606.1 |
| 55 | | Bacteria | *Bacillus licheniformis* | Pectin lyase | YP_079258.1 |
| 56 | | Fungi | *Aspergillus niger* | Endopolygalacturonase | CAB72125.1 |
| 57 | | Fungi | *Aspergillus niger* | Endopolygalacturonase | CAB72126.1 |
| 58 | | Fungi | *Aspergillus niger* | Endopolygalacturonase | XP_001390812.1 |
| 59 | | Fungi | *Aspergillus niger* | Endopolygalacturonase | CAB72931.1 |
| 60 | | Fungi | *Aspergillus niger* | Endopolygalacturonase | CAK44164.1 |
| 61 | | Fungi | *Aspergillus niger* | Pectin lyase | CAK48529.1 |
| 62 | | Fungi | *Aspergillus niger* | Pectin lyase | CAK37997.1 |
| 63 | | Fungi | *Aspergillus niger* | Pectin lyase | AAW03313.1 |
| 64 | | Fungi | *Aspergillus niger* | Pectin lyase | CAK47350.1 |
| 65 | | Fungi | *Aspergillus niger* | Pectin lyase | ACE00421.1 |
| 66 | | Fungi | *Trichoderma reesei* | Acetyl Xylan Esterase | Q99034 |
| 67 | | Fungi | *Aspergillus niger* | Feruoyl esterase | XP_001393337 |
| 60 | | Fungi | *Aspergillus niger* | Endopolygalacturonase | CAK44164.1 |
| 61 | | Fungi | *Aspergillus niger* | Pectin lyase | CAK48529.1 |
| 62 | | Fungi | *Aspergillus niger* | Pectin lyase | CAK37997.1 |
| 63 | | Fungi | *Aspergillus niger* | Pectin lyase | AAW03313.1 |
| 64 | | Fungi | *Aspergillus niger* | Pectin lyase | CAK47350.1 |
| 65 | | Fungi | *Aspergillus niger* | Pectin lyase | ACE00421.1 |
| 66 | | Fungi | *Trichoderma reesei* | Acetyl Xylan Esterase | Q99034 |

TABLE 15-continued

Amylolytic and other enzymes that were approved by FDA for feed and/or food use screened for functional expression in yeast. Grey boxes indicate enzymes that demonstrated functional expression in yeast.

| SE# | AE# | Organism | Source | Enzyme | Protein ID |
|---|---|---|---|---|---|
| 67 | | Fungi | *Aspergillus niger* | Feruoyl esterase | XP_001393337 |

TABLE 16

Amylolytic and other enzymes screened for functional expression in yeast.

| AE# | Organism | Source | Enzyme | Protein ID |
|---|---|---|---|---|
| 1 | Yeast | *Saccharomycopsis fibuligera* | Alpha-amylase | CAA29233.1 |
| 2 | Yeast | *Saccharomyces cerevisiae* | Glucoamylase | AAA35107.1 |
| 3 | Yeast | *Debaryomyces occidentalis* | Glucoamylase | AAA33923.1 |
| 4 | Yeast | *Pseudozyma tsukubaensis* | Alpha-glucosidase | CAA39501.1 |
| 5 | Yeast | *Debaryomyces occidentalis* | Alpha-amylase | AAB21151.2 |
| 6 | Bacteria | *Bacillus subtilis* | Alpha-amylase | AAA22194.1 |
| 7 | Yeast | *Debaryomyces occidentalis* | Alpha-amylase | CAA51912.1 |
| 8 | Yeast | *Saccharomycopsis fibuligera* | Glucoamylase | CAA41120.1 |
| 9 | Yeast | *Saccharomycopsis fibuligera* | Glucoamylase | CAC83969.1 |
| 10 | Yeast | *Saccharomycopsis fibuligera* | Alpha-glucosidase | CAF31354.1 |
| 11 | Yeast | *Lipomyces kononenkoae* | Alpha-amylase (pullulanase?) | AAC49622.1 |
| 12 | Yeast | *Lipomyces kononenkoae* | Alpha-amylase | AAO12212.1 |
| 13 | Bacteria | *Bacillus subtilis* | Alpha-amylase | ACM91731.1 |
| 14 | Bacteria | *Bacillus subtilis* | Alpha-amylase | CAL64397.1 |
| 15 | Bacteria | *Bacillus subtilis* | Pullulanase | AAC00283.1 |
| 16 | Bacteria | *Bacillus subtilis* | Isomaltase? | AAG23399.1 |
| 17 | Bacteria | *Bacillus subtilis* | Maltogenic alpha-amylase | AAF23874.1 |
| 18 | Bacteria | *Bacillus subtilis* | Isomaltase? | BAA23408.1 |
| 19 | Bacteria | *Bacillus subtilis* | Isomaltase? | ZP_03592917.1 |
| 20 | Bacteria | *Bacillus subtilis* | Isomaltase? | BAA22245.1 |
| 21 | Bacteria | *Clostridium phytofermentans* | Alpha-amylase | ABX42302 |
| 22 | Bacteria | *Clostridium phytofermentans* | Alpha-amylase/pullulanase Type I | ABX42665 |
| 23 | Bacteria | *Clostridium phytofermentans* | Pullulanase | ABX42692 |
| 24 | Bacteria | *Clostridium phytofermentans* | Alpha-amylase | ABX42702 |
| 25 | Bacteria | *Clostridium phytofermentans* | Alpha-amylase | ABX42703 |
| 26 | Bacteria | *Clostridium phytofermentans* | amylo-1,6-glucosidase (debranching) | ABX42704 |
| 27 | Bacteria | *Clostridium phytofermentans* | Alpha-amylase | ABX42705 |
| 28 | Bacteria | *Clostridium phytofermentans* | Alpha-amylase/neopullulanase | ABX42711 |
| 29 | Bacteria | *Clostridium phytofermentans* | Alpha-glucosidase | ABX44132 |
| 30 | Bacteria | *Clostridium phytofermentans* | Alpha-xylosidase | ABX40605 |
| 31 | Bacteria | *Clostridium phytofermentans* | Alpha-xylosidase/alpha-glucosidase | ABX42246 |
| 32 | Bacteria | *Clostridium thermocellum* | Alpha-amylase | ABN52030 |
| 33 | Bacteria | *Clostridium thermocellum* | Glucoamylase | ABN53008 |
| 34 | Bacteria | *Clostridium thermocellum* | Amylo-alpha-1,6-glucosidase (debranching) | ABN51356 |
| 35 | Bacteria | *Clostridium cellulolyticum* | Amylo-alpha-1,6-glucosidase (debranching) | ACL76625 |

TABLE 16-continued

Amylolytic and other enzymes screened for functional expression in yeast.

| AE# | Organism | Source | Enzyme | Protein ID |
|---|---|---|---|---|
| 36 | Bacteria | *Clostridium cellulolyticum* | Glucoamylase | ACL74721 |
| 37 | Bacteria | *Thermobifida fusca* | Alpha-amylase | AAZ54623 |
| 38 | Bacteria | *Thermobifida fusca* | Alpha-amylase/maltotriose-producing alpha-amylase | AAZ55023 |
| 39 | Bacteria | *Thermobifida fusca* | Alpha-glucosidase | AAZ54871 |
| 40 | Bacteria | *Thermobifida fusca* | Glucoamylase? | AAZ54084 |
| 41 | Bacteria | *Thermobifida fusca* | Glucoamylase? | AAZ55383 |
| 42 | Bacteria | *Thermobifida fusca* | Alpha-glucosidase/Alpha-xylosidase | AAZ55648 |
| 43 | Bacteria | *Anaerocellum thermophilum* | Alpha-amylase/pullulanase Type I | ACM59580 |
| 44 | Bacteria | *Anaerocellum thermophilum* | Alpha-amylase/pullulanase Type I | ACM59734 |
| 45 | Bacteria | *Anaerocellum thermophilum* | Glucoamylase (GH 15-related) | ACM59378 |
| 46 | Bacteria | *Anaerocellum thermophilum* | alpha-xylosidase | ACM61134 |
| 47 | Bacteria | *Thermoanaerobacterium saccharolyticum* | Alpha-amylase/amylopullulanase | * |
| 48 | Bacteria | *Thermoanaerobacterium saccharolyticum* | alpha-amylase/cyclomaltodextrinase | * |
| 49 | Bacteria | *Thermoanaerobacterium saccharolyticum* | Glucoamylase | * |
| 50 | Bacteria | *Thermoanaerobacterium saccharolyticum* | Glucoamylase | * |
| 51 | Bacteria | *Thermoanaerobacterium saccharolyticum* | Amylopullulanase | AAA19800 |
| 52 | Bacteria | *Streptomyces avermitilis* | Alpha-amylase/oligo-1,6-glucosidase | BAC69017 |
| 53 | Bacteria | *Streptomyces avermitilis* | alpha-glucosidase | BAC69435 |
| 54 | Bacteria | *Streptomyces avermitilis* | Isoamylase/glycogen debranching enzyme | BAC69862 |
| 55 | Bacteria | *Streptomyces avermitilis* | Isoamylase/glycogen debranching enzyme | BAC70500 |
| 56 | Bacteria | *Streptomyces avermitilis* | alpha-glucosidase | BAC73692 |
| 57 | Bacteria | *Streptomyces avermitilis* | Alpha-amylase | BAC73693 |
| 58 | Bacteria | *Streptomyces avermitilis* | Pullulanase | BAC73694 |
| 59 | Bacteria | *Streptomyces avermitilis* | Amylo-alpha-1,6-glucosidase (debranching) | BAC69169 |
| 60 | Bacteria | *Streptomyces avermitilis* | Amylo-alpha-1,6-glucosidase (debranching) | BAC73363 |
| 61 | Bacteria | *Streptomyces avermitilis* | Amylo-alpha-1,6-glucosidase (debranching) | BAC73364 |
| 62 | Bacteria | *Streptomyces avermitilis* | Glucoamylase (GH 15-related) | NP_827612 |
| 63 | Bacteria | *Streptomyces avermitilis* | Glucoamylase (GH 15-related) | NP_827679 |
| 64 | Bacteria | *Streptomyces avermitilis* | Glucoamylase (GH 15-related) | NP_821272 |
| 65 | Bacteria | *Streptomyces avermitilis* | Glucoamylase (GH 15-related) | NP_823108 |
| 66 | Bacteria | *Bacillus subtilis* | ARA1 arabinoxylanase | CAB13699.1 |
| 67 | Bacteria | *Bacillus subtilis* | ARA2 arabinan endo-1,5-alpha-L-arabinosidase | CAB15969.1 |
| 68 | Bacteria | *Bacillus subtilis* | ARA3 arabinan-endo 1,5-alpha-L-arabinase | CAA99586.1 |
| 69 | Bacteria | *Bacillus subtilis* | ARA4 arabinan endo-1,5-alpha-L-arabinosidase | AL009126 |
| 70 | Bacteria | *Bacillus subtilis* | ARA5 endo-arabinase | D85132 |
| 71 | Bacteria | *Clostridium phytofermentans* | ARA6 Arabinogalactan endo-1,4-beta-galactosidase | CP000885 |
| 72 | Bacteria | *Bacillus licheniformis* | ARA7 arabinan-endo 1,5-alpha-L-arabinase | AAU40201.1 |
| 73 | Bacteria | *Bacillus licheniformis* | ARA8 arabinan-endo 1,5-alpha-L-arabinase | AAU41895.1 |

TABLE 16-continued

Amylolytic and other enzymes screened for functional expression in yeast.

| AE# | Organism | Source | Enzyme | Protein ID |
|---|---|---|---|---|
| 74 | Bacteria | *Bacillus licheniformis* | ARA9 arabinogalactan endo-1,4-beta-galactosidase | AAU43089.1 |
| 75 | Bacteria | *Bacillus licheniformis* | ARA10 arabinan endo-1,5-alpha-L-arabinosidase | AAU43033.1 |
| 76 | Bacteria | *Bacillus licheniformis* | ARA11 endo-1,4-beta-xylanase | AAU39947.1 |
| 77 | Bacteria | *Thermoanaerobacterium saccharolyticum* | ARA12 Arabinogalactan endo-1,4-beta-galactosidase | * |
| 78 | Bacteria | *Thermoanaerobacterium saccharolyticum* | ARA13 Alpha-N-arabinofuranosidase | * |
| 79 | Yeast | *Arxula adeninivorans* | Glucoamylase | CAA86997.1 |
| 80 | Bacteria | *Klebsiella pneumoniae* | Pullulanase | ACI10956.1 |
| 81 | Fungi | *Hormoconis resinae* | Glucoamylase | CAA48243.1 |
| 82 | Fungi | *Aureobasidium pullulans* | Glucoamylase | ADN65121.1 |

* the gene sequence was obtained from genome sequence sequenced by Mascoma.

TABLE 17

Activity screening summary for yeast made alpha-amylases (AA), glucoamylases (GA), and alpha-glucosidases (AGL). Amount of pluses reflects relative activity level. NT—not tested. CO—codon optimized. Strains express individual enzymes on 2u vector pMU1575 in M0509 or M0139 background strains.

| AE# | SE# | Source | Enzyme | Activity Assay DNS Starch AA/GA | GHK Starch GA | Maltose AGL | Corn Mash All | Strain* |
|---|---|---|---|---|---|---|---|---|
| 1 | | *Saccharomycopsis fibuligera* | AA | ++ | − | | + | M1910 |
| 5 | | *Debaryomyces occidentalis* | AA | ++ | − | | + | M1911 |
| 6 | 1 | *Bacillus subtilis* | AA | ++ | + | + | ++ | M1912 |
| 7 | | *Debaryomyces occidentalis* | AA | ++ | − | − | ++ | M1913 |
| 11 | | *Lipomyces kononenkoae* | AA | − | − | − | NT | |
| 12 | | *Lipomyces kononenkoae* | AA | + | + | − | NT | M1914 |
| 13 | 2 | *Bacillus subtilis* | AA | ++ | + | − | + | M1915 |
| | 15 | *Bacillus licheniformis* | AA | ++ | − | − | ++ | M1916 |
| | 30 | *Aspergillus niger* | AA | − | − | − | − | |
| 2 | 10 | *Saccharomyces cerevisiae* | GA | − | − | − | − | |
| 3 | | *Debaryomyces occidentalis* | GA | − | + | ++ | − | M1917 |
| 8 | | *Saccharomycopsis fibuligera* | GA | +++ | +++ | +++ | +++ | M1918 |
| 8CO | | *Saccharomycopsis fibuligera* | GA | + | + | + | NT | |
| 9 | | *Saccharomycopsis fibuligera* | GA | +++ | +++ | +++ | NT | M1919 |
| 49 | | *T. sacch* | GA | + | ++ | ++ | +++ | M1920 |
| | 11 | *Aspergillus niger* | GA | ++ | +++ | + | +++ | M1921 |
| | 11CO | *Aspergillus niger* | GA | − | − | − | − | |
| | 12 | *Aspergillus oryzae* | GA | − | − | − | NT | |
| | 13 | *Rhizopus oryzae* | GA | − | − | − | NT | |
| 4 | | *Pseudozyma tsukubaensis* | AGL | − | − | − | + | M1922 |

TABLE 17-continued

| 10 | | Saccharomycopsis fibuligera | AGL | – | – | +++ | NT | M1923 |
|---|---|---|---|---|---|---|---|---|
| | 14 | Aspergillus niger | AGL | – | – | +++ | +++ | M1924 |

*Strains expressing individual enzymes on 2u vector pMU1575 in M0509 or M0139 background strains

| genes PCRed | NT | Not tested |
|---|---|---|
| genes ordered from GeneArt | – | No Activity |
| genes ordered from DNA 2.0 | + | Some Activity |
| | ++ | Good Activity |
| | +++ | Best Activity |

Example 20

Screening of Amylolytic and Accessory Enzymes for Synergy with AE8

Particular combinations of hydrolytic enzymes were selected for the best conversion of particular substrates such as corn mash. This was achieved due to screening of over one hundred enzymes for functional expression in yeast, synergy with each other, and performance in industrially relevant bioprocess conditions. Particular combinations include: AE9; AE9+AE8; AE9+AE1; AE9+AE7; AE9+AE10; AE9+AE8+AE10; AE9+AE7+AE10; AE9+AE7+AE8+AE10; AE1+AE8+AE9+AE10; and all other combinations of AE1, AE7, AE8, AE9, and AE10 (see Tables 16 and 19). Other particular combinations of hydrolytic enzymes that demonstrated high glucose release from substrates such as pretreated corn fiber and corn syrup (concentrated liquid fraction left after corn mash fermentation) include: "core" cellulases, xylanase, xylosidase, glucoamylase (AE9), alpha-amylase (AE7), isopullulanase (SE35), alpha-glucosidase (AE10), acetylxylan esterase (*T. reesei* AXE), and pectinase.

Figure 43:
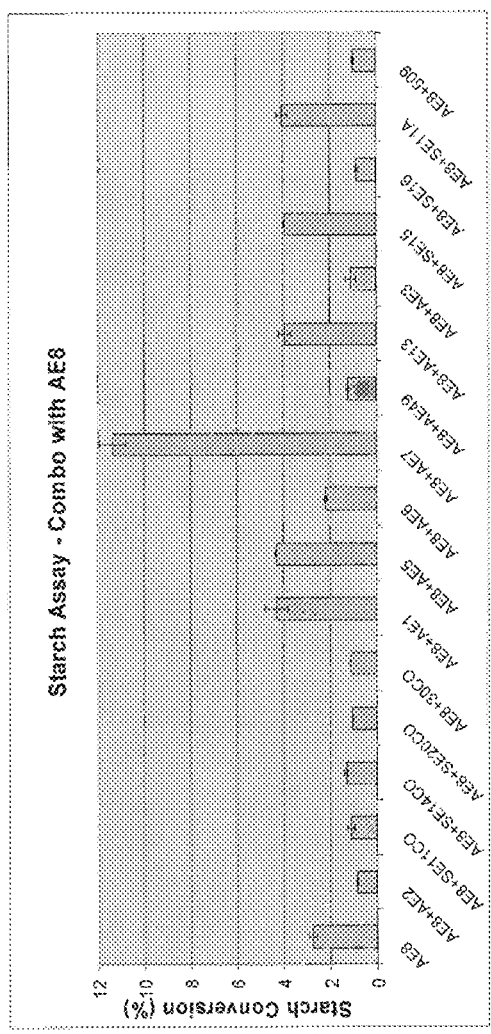
FIG. 43 depicts starch activity of yeast made amylolytic enzymes in combination with yeast made AE8. Supernatants of strains grown for 3 days in YPD were mixed with supernatant of AE8 expressing strain at 50:50 ratio. In the first sample AE8 supernatant was 100%. Supernatant of M0509 was used as negative control. "CO"—codon optimized for yeast synthetic genes; others—PCRed from genomic DNA or cDNA.
Figure 44:
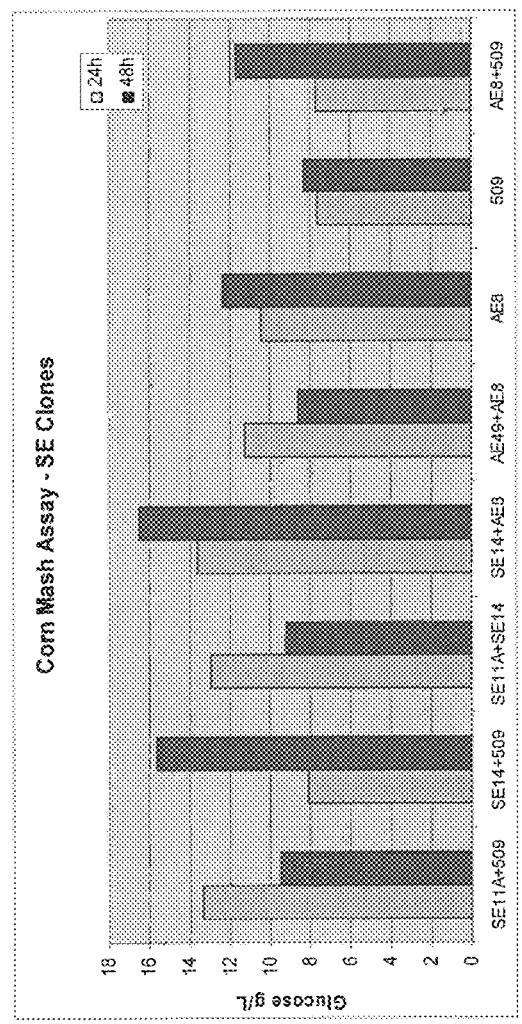
FIG. 44 depicts a corn mash assay for new secreted genes individually and in combination with AE8. Supernatants of strains grown for 3 days in YPD were mixed with supe of AE8 expressing strain at 50:50 ratio. Supernatant of M0509 was used as negative control.
Figure 45:
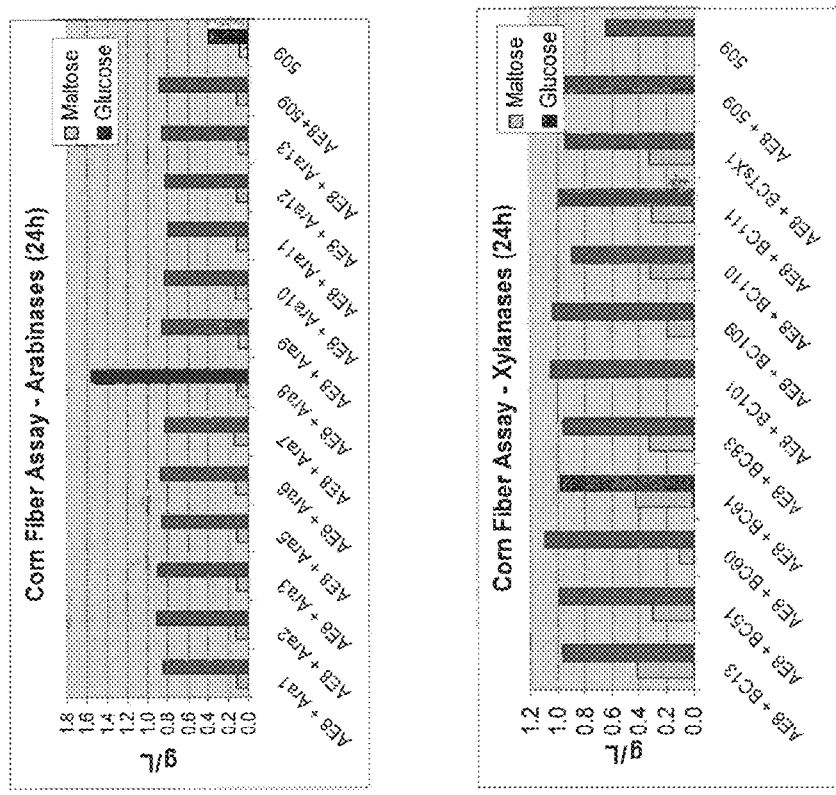
FIG. 45 depicts the effect of arabinases (top) and xylanases (bottom) added to AE8 on glucose release from non pretreated corn fiber. Supernatants of strains grown for 3 days in YPD were mixed with supernatant of AE8 expressing strain at 50:50 ratio. Supernatant of M0509 was used as negative control. Arabinases are described in Table 16 (AE67-78). 'BC' genes are described in Table 7. "BCTsX1" is the putative xylanase gene PCR amplified from *Thermoanaerobacterium saccharolyticum* genomic DNA based on genome sequence obtained at Mascoma.

The enzymes that had the best secreted activity in yeast were combined and screened for the best synergy with each other. FIGS. 43-45 demonstrate examples of screening enzymes in combination. Several amylolytic enzymes were screened for synergy with AE8 by Starch-DNS, Corn Mash and Fiber assays. Supernatants of strains grown for 3 days in YPD were mixed with supernatant with AE8 at 50:50 ratio. In the first sample of FIG. 43. AE8 supernatant was 100%. Supernatant of M0509 host strain was used as negative control. FIG. 43 shows that several AAs and SE11 glucoamylases had positive effect on glucose release when added to AE8 compared to when additional AE8 added. AE7 alpha-amylase had particularly strong effect. FIG. 44 shows that on corn mash SE14 alpha-glucosidase had positive effect on glucose release when combined with AE8.

The effect of arabinases and xylanases on glucose release from non pretreated corn fiber in the presence of AE8 was also analyzed (FIG. 44). FIG. 44 shows that Ara8 had positive effect on glucose release from fiber. Several xylanases also had some effect on glucose release from fiber when added to AE8 (FIG. 45). The information obtained from the screening of enzyme combinations was used to select the optimal set of enzymes for a particular substrates such as corn mash, pretreated corn fiber and corn syrup.

Example 21

Figure 46:
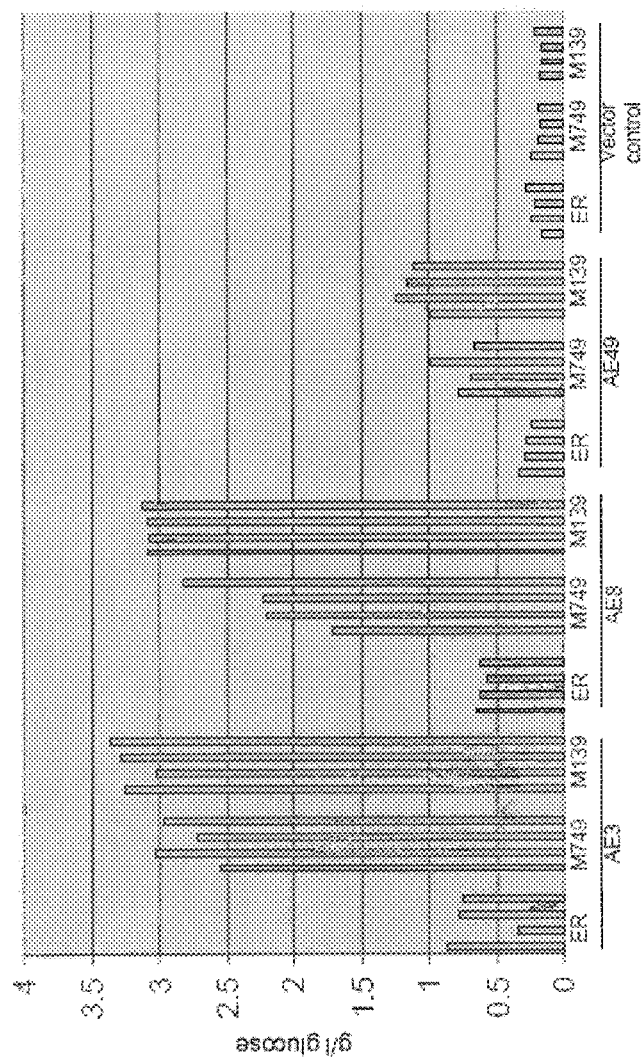
FIG. 46 depicts the expression of amylolytic enzymes in different industrial strains. The expression level of amylases AE3, AE8, and AE49 (see Table 16) was evaluated by activity of supernatants on maltose. All genes were subcloned into pMU1575 2u expression vector by yeast mediated ligation and transformed into one of three strains. Transformants were grown in YPD for 3 days and supernatants were analyzed for activity by Maltose assay. Four transformants were analyzed for each transformation.

Screening Industrial Strains for High Ethanol Yield and Heterologous Protein Production In order to choose the industrial host strain for engineering amylases several industrial and Mascoma developed strains were screened for production of ethanol from liquefied corn mash in the presence of standard dose of commercial glucoamylases (data not shown). Two of the best performing strains. M0212 which is a well established high performance ethanologen, and M0139 which is a high performance ethanologen from the distillery industry, were chosen for further evaluation. Since success of the CBP process is dependent on sufficient expression of heterologous genes in an industrial yeast strain, the strains were compared for their ability to express amylases. Three strains were evaluated: two strains selected for high ethanol yield, M0212 and M0139, and M0749—a Mascoma robust strain that does not achieve the ethanol titers of M0212 and M0139 but is known to produce high levels of heterologous proteins (McBride et al., WO 2010/06000056, 2010). The activity levels of three different glucoamylases (AE3, AE8, and AE49) were measured in culture supernatants of the above strains when expressed from a multicopy 2μ pMU1575 plasmid. The results are shown in FIG. 46 using maltose as the substrate. Similar results were obtained using starch (data not shown). The results clearly show that expression is lowest when M0212 is the production platform for all enzymes tested. However, strain M0139 served as the best secretion platform and is also a comparable ethanologen to M0212. A similar trend was also observed when an alpha amylase (SE15) was expressed in all three strain backgrounds and activity was measured on starch. Based on these results M0139 strain was selected as host background strain for engineering CBP strains.

Example 22

Engineering of Marker Free Stable Amylolytic Strains in Industrial Background

Two approaches were utilized to engineer strains expressing amylolytic enzymes: random integration and directed integration. In both cases the genes were stably integrated into the genome. When using a radon integration approach, amylolytic genes were integrated into delta sites by selection of a linked auxotrophic marker. Several genes were integrated at the same time in different combinations and transformants were screened on starch containing URA-plates. When the directed integration approach was used, the genes were integrated into designated loci. Both approaches are described in more details below.

Construction of Strains by Random Integration

Figure 47:
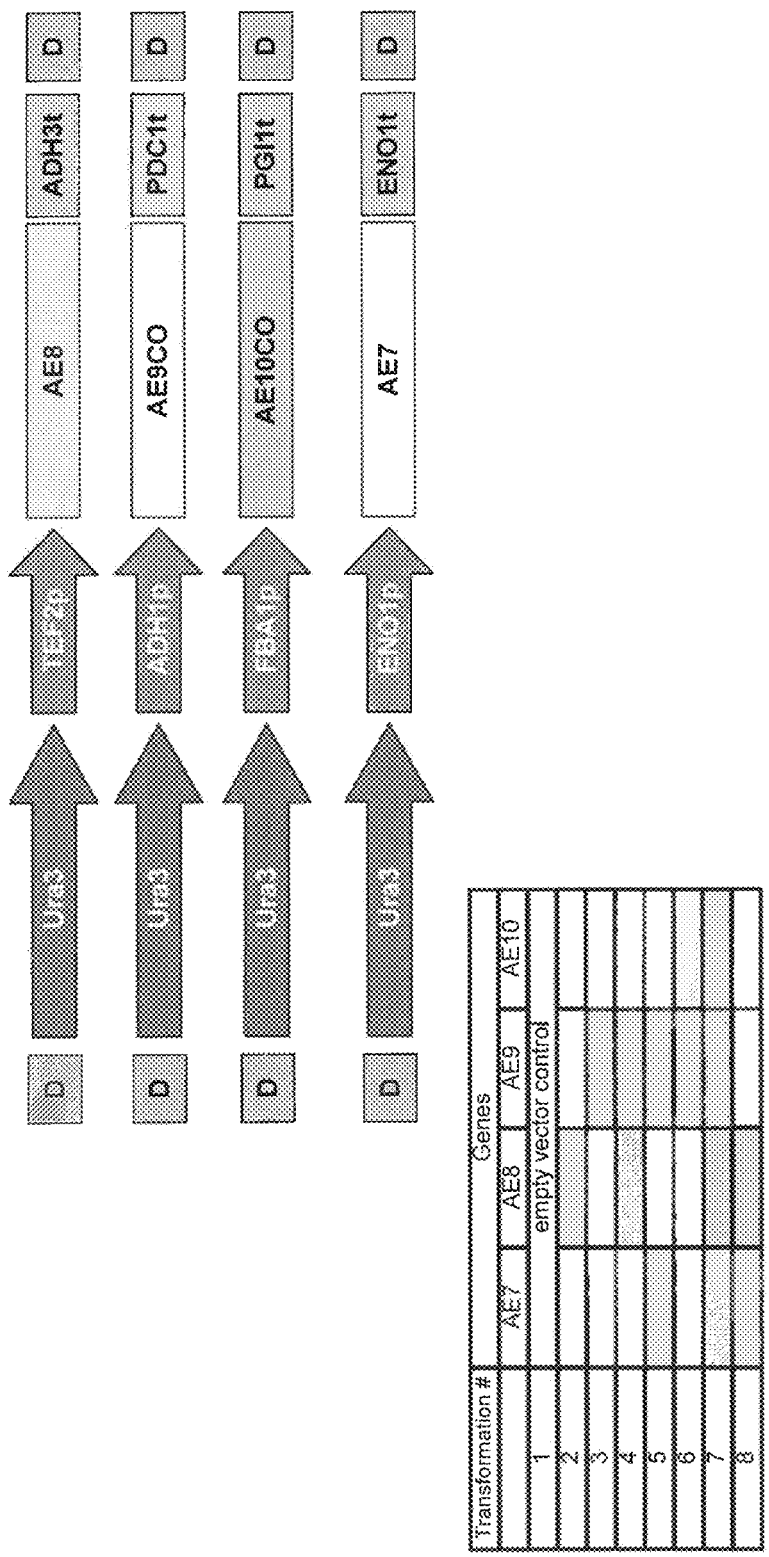
FIG. 47 depicts expression constructs used for random integration strain construction (top). P—*S. cerevisiae* promoter; t—*S. cerevisiae* terminator, URA3—*S. cerevisiae* URA3 marker; D—delta integration sites; "CO"—codon optimized synthetic genes. Combinations of genes used for random integration (bottom). Genes used in each combination are marked gray.
Figure 48:
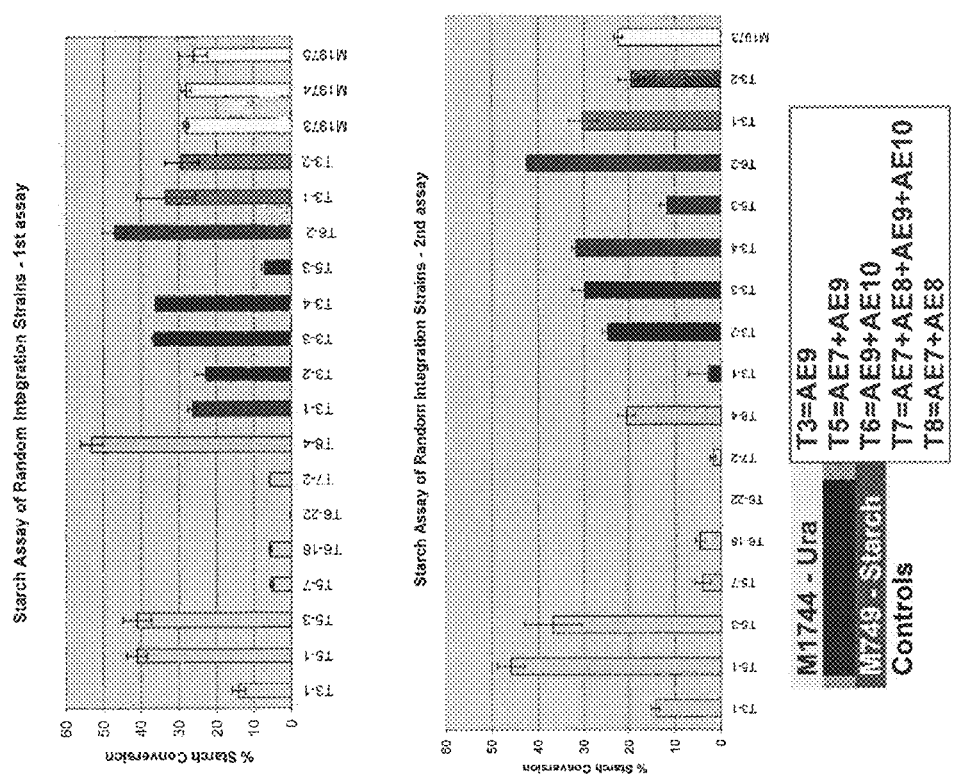
FIG. 48 depicts the secreted activity on starch of strains built by random integration. Supernatants of strains grown for 3 days in YPD were used in starch-DNS assay. Ura—transformants were selected from SD-URA plates; Starch—transformants were selected from YM-Starch plates (1×YNB plus 0.5% starch); Controls—strains do not express amylases. CBP strain-M1973 was used as a positive control. The same experiment was repeated twice in duplicates: $1^{st}$ experiment—top: $2^{nd}$ experiment—bottom.

In order to study the potential of random integration and the starch plate selection approach for strain construction, four integrative constructs with the most active amylolytic enzymes were built (FIG. 47, top). The constructs contain alpha-amylase, 2 glucoamylases, and alpha-glucosidase under different promoters and terminators attached to URA3 marker and flanked by delta integration sites. The constructs were mixed at equal amounts in 7 different combinations (FIG. 47, bottom) and 3 µg of total DNA was transformed into industrial strains M1744 (M0139 background) and M0749 (M0509 background). Transformants were plated on SD-URA plates and on YM-Starch plates (1×YNB plus 0.5% starch). It was found that starch selection without additional marker works for strains with M0509 strain background but does not in M0139 background strains. Nevertheless the combination of starch and URA selection worked for M0139 strains (a large number of background colonies are obtained if only starch used as marker for M0139 strains). The transformants selected from both kinds of plates and in both host backgrounds were screened by Starch-DNS assay. The top hits were tested again in duplicates twice (FIG. 48). As a result several strains were made with high secreted activity on starch. The combinations that made the strains with the highest activity included: AE9 alone, AE8+AE7, AE9+AE10, and AE9+AE7.

Construction of Strains by Directed Integration

Figure 49:
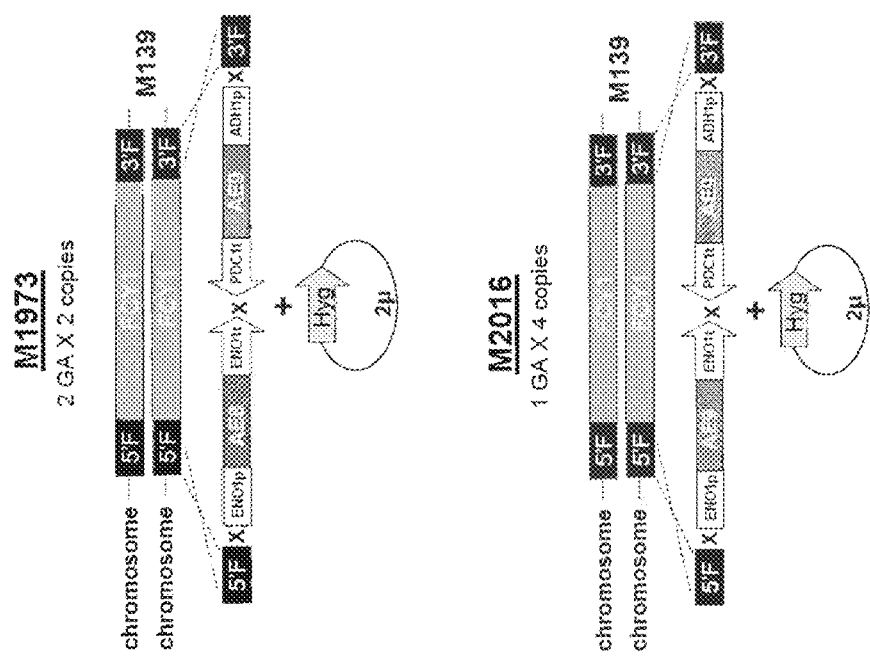
FIG. 49 depicts a scheme of directed integration strain construction approach with negative selection marker FCY1 used as integration site. Amylolytic strains M1973 and M2016 expressing glucoamylases AE8 and/or AE9 were used as examples. The expression cassettes flanking regions of FCY were integrated into FCY1 locus (position ~677162 on chromosome 16) of industrial strain M0139 as PCRed DNA fragments with overlapping ends. The host M0139 is a diploid, therefore each expression cassette was integrated in two copies. The 2-μ plasmid with Hyg marker was co-transformed with PCR products. The transformants were first cultivated in liquid YPD+Hyg media overnight and then plated on media with FCY knock-out selective compound 5-fluorocytosine. Precultivation on media with antibiotic increases efficiency of double FCY1 knock-out.

The directed integration approach creates transgenic strains with integration events that are easier to characterize. Any mistargeting events can be easily identified with a Southern blot. Additionally, strains engineered by directed approach are potentially more stable since each expression cassette at the chromosome is integrated into a unique site (not tested). URA3 and FCY1 negative selection approaches were both developed. FCY1 was eventually chosen as the marker of choice since fcy mutation did not effect robustness of the strains. Using this technology, many clean strains were built in the industrial strain background. FIG. 49 demonstrates how glucoamylase expression cassettes were integrated into FCY1 locus. In this case, counter selection for the FCY1 knock out also selects for integration of the glucoamylase expression cassette. In the expression cassettes, the glucoamylase genes are under control of a strong promoter from various central metabolism genes. When multiple copies are used, the expression cassettes containing the same sequences are oriented toward each other to decrease the chance of spontaneous recombination. The glucoamylase expression cassettes were transformed into industrial strain M0139 as PCR products with homologous ends targeting the upstream and downstream regions of the FCY locus. Since removal of both copies of FCY is necessary for resistance to 5-fluorocytosine (5-FC), each expression cassette was found to be integrated on both chromosomes. A 2-µ plasmid, which contains a cassette to expresses the Hygromycin resistance gene marker (Hyg), was co-transformed with the PCR products. The transformants were first cultivated in liquid YPD+Hyg (300 ug/ml) media overnight and then plated on media containing 5-fluorocytosine. Precultivation on media with antibiotic increases efficiency of double FCY1 knock-out. This approach was also utilized with other negative selection markers such as URA3. Genetic manipulations at the FCY locus result in strains that are marker free and can be easily modified by recycling the FCY marker. For instance, additional copies of AE8 and AE9 could be placed at other loci.

Figure 50:
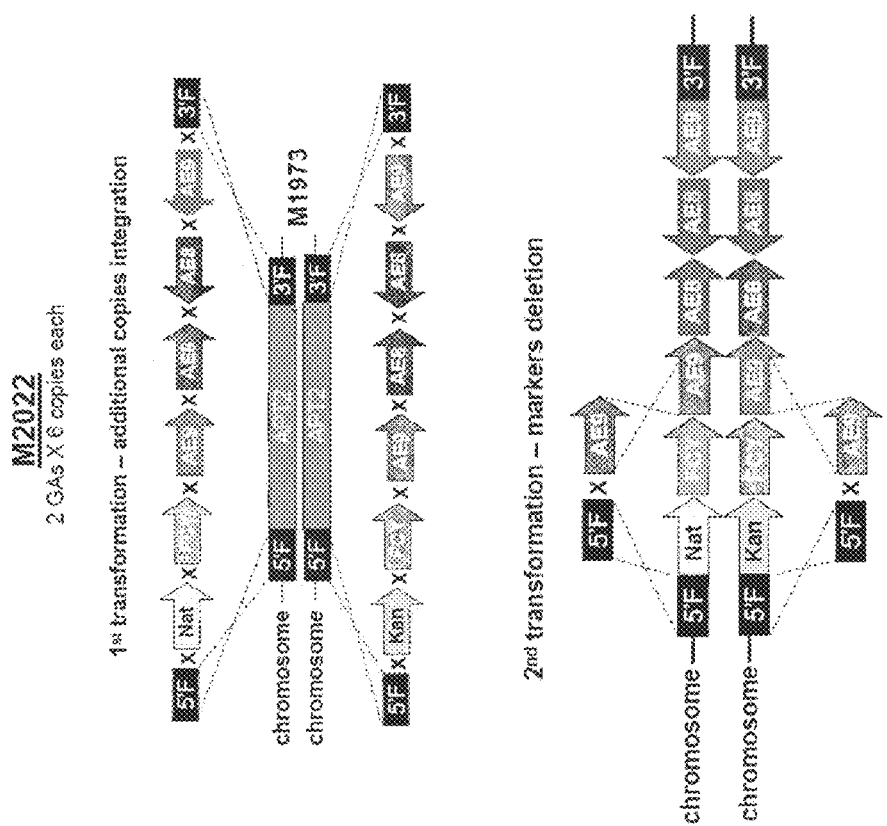
FIG. 50 depicts integration of additional copies of glucoamylase into a genomic site such as an Adenine-phosphoribosyltransferase 2 (APT2) locus.
Figure 51:
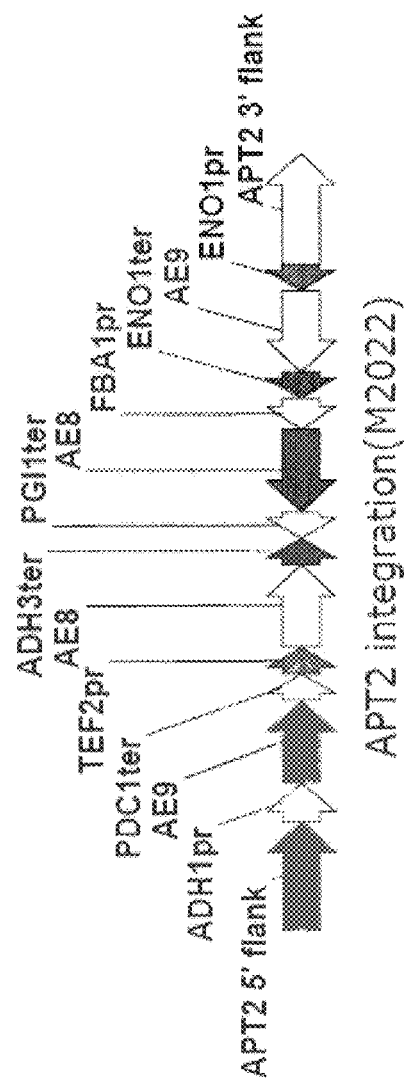
FIG. 51 depicts a scheme of directed integration strain construction approach with universal integration site. Amylolytic strain M2022 expressing multiple copies of glucoamylases AE8 and AE9 was used as an example. In the first round of transformation (top) four additional glucoamylase expression cassettes together with APT2 flanking regions, dominant markers (Nat and Kan) and FCY1 marker were integrated into APT2 locus (position ~1345055 chromosome 14) into industrial strain M1973 (already expressing 4 glucoamylase copies, see FIG. 50) as PCRed DNA fragments with overlapping ends. The transformants were plated on YPD+Nat+Kan plates that allow growth only for cells that have both dominant markers integrated into different copies of chromosome. In the second round of transformation (middle) the transformants selected for the high amylolytic activity by Starch-DNS assay were transformed with two PCR products that have overlapping ends: 5'-APT2 flanking region and 5' part of AE9 expression cassette. The transformants were patched on 5-fluorocytosine containing media that allows selection for lack of FCY1. On the bottom of the figure the final APT2 integration locus of M2022 shown. It also shows which *S. cerevisiae* promoters (pr) and terminators (ter) were controlling expression of newly added AE8 and AE9.

FIG. 50 demonstrates how more glucoamylase copies could be integrated into another site such as an Adenine-phosphoribosyltransferase 2 (APT2) locus. In the first round of transformation four additional GA expression cassettes are amplified by PCR with homologous tails for each other and a region upstream and down stream of the APT2 locus. Dominant markers (Nat and Kan) and the FCY1 marker were integrated into APT2 locus into industrial strain M1973 (already expressing 4 GA copies, FIG. 49) as PCR products with overlapping ends together with 4 additional GAs. The transformants were plated on YPD+Nat+Kan plates that allow growth of cells that have both dominant markers integrated on the chromosome. Transformants were screened for the high amylolytic activity by Starch-DNS assay. The strain demonstrating the highest activity was chosen and the Kan and Nat markers were removed by transformation of two PCR products that have homologous ends for each other, the APT2 upstream flanking region and the 5'—part of AE9 expression cassette. The transformants were plated on 5-fluorocytosine containing media that selects for strains that have lost FCY1. In this approach, expression cassettes can be integrated into any yeast site as long is the event does not perturb an essential function. The strains with the highest activity on starch were evaluated further by corn mash fermentation in bioreactors.

Example 23

Evaluation of Amylolytic Strains by Corn Mash Fermentation

Figure 52:
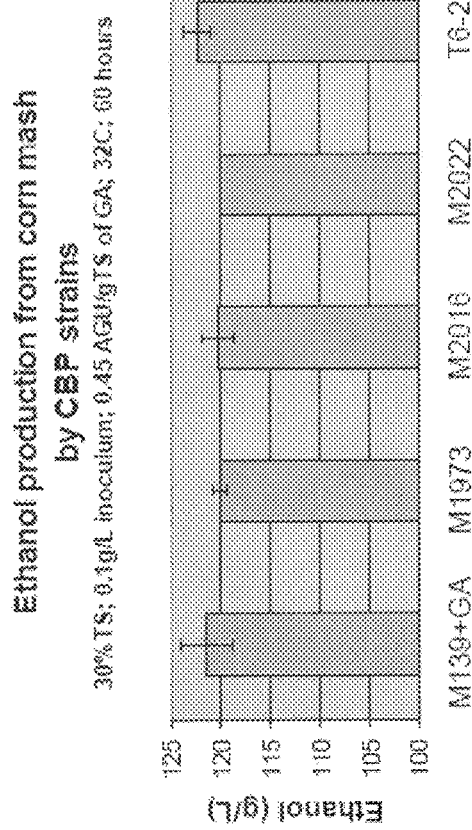
FIG. 52 depicts ethanol produced by amylolytic yeast without exogenous glucoamylase from liquefied corn mash. The numbers are average of triplicate runs and error bars are 1 std. Inoculum of 0.1 g/L was used. Fermentations were performed in 250 mL sealed shake flasks with a total fermentation mass of 50 g on corn mash obtained from Valero bio-refinery at 30% solids (TS) at a fermentation temperature of 32° C. at a shaking speed of 125 rpm. The fermentations were performed using 500 ppm urea as the only nutrient source. Standard dose (0.45 AGU/g TS) of commercial glucoamylase (Spirizyme Ultra, Novozymes) was added to the control strain M0139. All other strains were fermented without any exogenous enzymes added. The ethanol produced after 60 h is shown.

Several amylolytic CBP strains that demonstrated the highest activity in screening assays were evaluated for their ability to produce ethanol from liquefied corn mash. The strains used for this experiment were built by either directed or random integration and express different combinations of amylases from *Saccharomycopsis fibuligera* (Tables 18, 19). Background non-amylolytic M0139 strain was used as control. Fermentations were performed in sealed shake flasks on corn mash obtained from Valero bio-refinery at 30% solids (TS) at a fermentation temperature of 32° C. at a shaking speed of 125 rpm. The fermentations were performed using 500 ppm urea as the only nutrient source. Standard dose (0.45 AGU/g TS) of commercial glucoamylase glucoamylase (Spirizyme Ultra, Novozymes) was added to the control strain M0139. All other strains were fermented without any exogenous enzymes added. The ethanol produced after 60 hours of fermentation shown in FIG. 52. FIG. 52 shows that all CBP strains produced ethanol in an amount similar to the control strain with full dose of glucoamylase. The T6-2 strain produced the same amount of ethanol in 60 hrs without any added enzymes as control strain M0139. This is the first demonstration of full CBP effect demonstrated at commercial ethanol production level, when yeast produced enzymes completely replaced exogenous enzyme added in standard commercial process.

TABLE 18

Description of strains used for fermentation in FIG. 52. The genes AE8, AE9, and AE10 described in Tables 16 and 19.

| Strain | Description |
|---|---|
| M0139 | Non-CBP strain with full commercial dose of Glucoamylase (GA) |
| M1973 | Directed Integration (DI) of 2AE8, 2AE9 at FCY site |
| M2016 | Directed Integration (DI) of 4AE9 at FCY site |
| M2022 | DI of M01973 with 4 copies AE8 and 4 copies AE9 at APT2 site |
| T6-2 | Random Integration (RI) of AE9 and AE10 at delta sites |

TABLE 19

Protein and DNA sequences of amylases used to build CBP strains.

| Seq# | Seq Name | Gene Source | Protein | DNA |
|---|---|---|---|---|
| 1 | AE1 | Gene was obtained by PCR with *Saccharomycopsis fibuligera* genomic DNA as template (ATCC#9947) | MQISKAALLASLAALV YAQPVTLFKRETNADK WRSQSIYQIVTDRFAR TDGDTSASCNTEDRLY CGGSFQGIIKKLDYIK DMGFTAIWISPVVENI PDNTAYGYAYHGYWMK NIYKINENFGTADDLK SLAQELHDRDMLLMVD IVTNHYGSDGSGDSID YSEYTPFNDQKYFHNY CLISNYDDQAQVQSCW EGDSSVALPDLRTEDS DVASVFNSWVKDFVGN YSIDGLRIDSAKHVDQ GFFPDFVSASGVYSVG EVFQGDPAYTCPYQNY IPGVSNYPLYYPTTRF FKTTDSSSSELTQMIS SVASSCSDPTLLTNFV ENHDNERFASMTSDQS LISNAIAFVLLGDGIP VIYYGQEQGLSGKSDP NNREALWLSGYNKESD YYKLIAKANAARNAAV YQDSSYATSQLSVIFS NDHVIATKRGSVVSVF NNLGSSGSSDVTISNT GYSSGEDLVEVLTCST VSGSSDLQVSIQGGQP QIFVPAKYASDICS | atgcaaatttcaaaagctgctttgcttgcct cattggctgcccttgtttatgctcaaccagt gactctattcaaaagagaaactaatgctgat aaatggagatcacagtctatttatcaaattg tcactgacagatttgctagaaccgatggtga tacaagtgcttcctgtaacacagaagataga ctttactgtggtggttctttccaaggcatca taaagaagttggattacatcaaagatatggg ctttactgctatttggatttctccagttgtt gaaaacattcccgataacacagcatatggtt atgcttatcatggttactggatgaagaacat atacaaaattaatgaaaactttggtactgct gatgatttgaagtctttggcacaagaattgc acgatcgtgatatgttgttaatggtcgatat cgttaccaaccattacggcagtgatggcagt ggagatagtatcgattactcagagtacaccc cgttcaacgaccaaaagtacttccataacta ctgtcttatttcaaactatgatgaccaagct caggttcaaagttgctgggaaggtgactctt cagttgcattaccagatttgagaacggaaga tagcgacgtggcctcagttttcaattcttgg gttaaagattttgttggcaattactcaattg atggtttaagaattgatagtgctaaacatgt ggaccaaggcttttccccggatttttgttagt gcatctggagtttactcagtaggcgaagttt tccaaggagacccagcttatacatgcccata ccaaaattacattccaggggttagtaattat ccattgtactacccaaccacgagattttta aaactactgattcaagttccagtgagttgac tcaaatgatttcaagcgttgcttccagttgt tcggatccaacttttgttgacaaactttgtag aaaatcacgataatgaaaggttcgcttcaat gaccagcgaccaaagtttgatttctaatgct attgcatttgtcctttttgggtgatggtattc ctgtcatttactatggacaagaacaaggctt gagcggaaaaagtgacccaaacaacagagag gccttgtggttatccggctacaacaaagaga gtgactattacaagctcattgccaaagctaa tgctgccagaaacgccgccgtttatcaagac tcaagctatgccacctcgcagctttctgtga tcttttcaaatgaccatgttattgcaacaaa aagaggcagcgttgtttctgttttcaacaac cttggttccagcggttcttctgatgtgacta tttccaacacaggttacagttccggtgagga tttggtagaagttttgacatgcagtactgtt agcggcagctctgacttacaagtttctatcc aaggtggtcaaccacacaaatctttgttcctgc taaatatgcttctgacatttgttca |
| 2 | AE7 | Gene was obtained by PCR with *Debaryomyces occidentalis* genomic DNA as template (ATCC#26077) | MKFATILSTTALALSS LVASKPIFLSKRDAGS SAAAAWRSESIYQLVT DRFARTDGSTSATCNT GDRVYCGGTFQGIIDK LDYIQGMGFTAIWISP VVEQIPDDTGYGYAYH GYWMKDIYAINSNFGT ADDLKNLSNELHKRNM KLMVDIVTNHYAWNGA GSSVAYSNYNPFNQQS YFHDYCLITNYDDQTN VEDCWEGDNTVSLPDL RTEDSDVSSIFNLWVA ELVSNYSIDGLRIDSA KHVDESFYPSFQSAAG VYLLGEVYDGDPAYTC PYQNYMSGVTNYPLYY PMLRFFQGTSNSVDEL NAMISSLESDCKDITL LGNFIENHDQPRLPSY TSDSALIKNAIAFNLM SDGIPIIYYGQEQGYS GSSDPNNREALWLSGY | atgaaatttgcaactatcttaagtacaactg ctcttgcgctatcaagtttggttgcatccaa gccaattttcttaagcaaaaggagtgctggc agctctgctgctgcagcttggcgttctgaat ctatctatcaacttgttaccgatagatttgc cagaactgacggatcgacttcagctacttgt aatactggagatagagtatactgtggggggta ctttccaaggtattattgacaaattgatta catccaaggtatgggtttcactgctatttgg atttctccagttgttgaacaaattcctgatg atactggttatggttatgcttaccacggcta ttggatgaaagatatttacgctataaattca aattttggtactgccgatgacttgaagaatc tttcaaatgaattgcataagagaaatatgaa gcttatggttgatattgttactaaccattat gcttggaatggtgccggtagcagtgttgctt actccaactacaatccattcaaccaacaatc ctacttccacgattattgtttaattacaaat tacgatgatcaaaccaatgttgaagattgct gggaaggcgataatactgttagtttaccaga tcttcgtactgaggattcagatgttagctct attttcaatctgtgggttgctgagttagttt ctaattactcaattgatggtttaaggattga cagtgctaagcatgttgatgaatcattctac |

TABLE 19-continued

Protein and DNA sequences of amylases used to build CBP strains.

| Seq# | Seq Name | Gene Source | Protein | DNA |
|---|---|---|---|---|
| | | | STSNGYYKLISSVNQI RNQAIYKDSKYTTYWS DVLYASGHVIALQRGA DDQRIVSVFNNLGSSG SQTVTFSTKYSGGEKV VDVLTCQTSYANSDST LTVSISGGAPRIYAPA SLIANSGICNF | ccatcattccaaagtgctgcaggtgtctatc ttcttggagaagtttatgacggtgatccagc ttacacttgcccataccaaaactatatgtca ggggttactaactatcctttgtactatccaa tgttaagattcttcaaggtacttctaactc tgtcgatgaattaaatgctatgatttcaagt ttagaaagtgattgtaaggatattactttat tgggtaatttcattgaaaaccatgatcaacc aagattaccatcttatacttctgatagtgcc ttaatcaaaaatgcaattgcgtttaatttaa tgtcagatggtattccaattatttactacgg tcaagaacaaggttacagtggtagctccgat ccaaacaacagagaagcattatggttatctg gttacagcactagtaatggttactacaaact tatctcttcagttaatcaaattagaaaccaa gccatttataaggatagcaaatacactactt attggagtgatgtgttatacgcttcaggtca tgttattgctcttcaaagaggtgcagacgac caaagaattgtttctgtctttaacaattta gctcaagcggatctcaaactgtaacattcag tactaaatacagcggtggagaaaaagtcgtt gacgttttaacttgtcaaacttcatacgcca actcggatagtactttaactgtctctattag tggtggcgctccaagaatttatgctcctgct tctcttattgcaaattctggaatttgcaact tc |
| 3 | AE8 | Gene was obtained by PCR with Saccharomycopsis fibuligera genomic DNA as template (ATCC#9947) | MRFGVLISVFAAIVSA LPLQEGPLNKRAYPSF EAYSNYKVDRTDLETF LDKQKEVSLYYLLQNI AYPEGQFNNGVPGTVI ASPSTSNPDYYYQWTR DSAITFLTVLSELEDN NFNTTLAKAVEYYINT SYNLQRTSNPSGSFDD ENHKGLGEPKFNTDGS AYTGAWGRPQNDGPAL RAYAISRYLNDVNSLN EGKLVLTDSGGINFSS TEDIYKNIIKPDLEYV IGYWDSTGFDLWEENQ GRHFFTSLVQQKALAY AVDIAKSFDDGDFANT LSSTASTLESYLSGSD GGFVNTDVNHIVENPD LLQQNSRQGLDSATYI GPLLTHDIGESSSTPF DVDNEYVLQSYYLLLE DNKDRYFVNSAYSAGA AIGRYPEDVYNGDGSS EGNPWFLATAYAAQVP YKLAYDAKSASNDITI NKINYDFFNKYIVDLS TINSAYQSSDSVTIKS GSDEFNTVADNLVTFG DSFLQVILDHINDDGS LNEQLNRYTGYSTGAY SLTWSSGALLEAIRLR NKVKALA | atgagattcggtgttttaatctccgtctttg ctgctattgttagtgctttaccttgcaaga aggtcctttgaacaaaagagcctatccttct tttgaagcttattcaaactataaagttgaca gaactgacttggaaaccttcttggacaaaca aaaagaagtatctttatactatcttttacaa aacattgcttatcctgaaggccaatttaata atggtgttcctggtactgttattgcttctcc atcaacctctaatccggactactattaccaa tggaccagagattccgcaattacattttga cagttctttctgaactagaagataataactt caataccactttggccaaggcagttgagtac tacattaacaccagttacaaccttcaaagaa ccagtaaccaaagtggcagcttttgatgatga aaatcataaaggcttgggagaaccaaaattt aacacagatggttctgcatacaccggagctt gggggagaccgcaaaatgatggtcctgcttt gagagcttatgctatcagtagatacttgaat gatgtcaattcttaaatgaaggtaaattag tattgactgattcaggtggtatcaacttttc ttcaactgaagatatttacaaaaatatcatc aaaccagacttggaatatgttataggggtact gggattctactgggtttgatcttgggagga aaaccaaggcagacacttttttacaagcttg gttcaacagaaagcccttgcttatgctgtcg atattgccaaaagttttgacgacggcgactt tgcgaacacactttcttcgactgcttctacc ctcgaaagttatttgagtggcagtgatggtg gatttgttaatactgatgttaaccacattgt tgaaaacccagatttgcttcaacaaaactct agacaaggtctagattcagccacatatattg gcccacttttgactcatgatattggtgaaag cagctcaactccatttgatgttgacaatgag tatgttttgcaatcatattacttgttattgg aggataacaaagacagatactttgttaacag tgcttattctgctggtgcagctattggcaga tacccagaagatgtttacaatggtgatggtt catctgaaggcaatccatggttcttagctac tgcctatgctgcccaagttccatacaaactt gcttatgatgcaaagtcggcctcaaatgaca ttaccattaacaagattaactacgatttttt taacaagtatattgttgatttatctaccatc aattctgcttaccagtcttctgatagtgtca ccattaaaagtggctctgatgaatttaacac ggttgctgataatttggtcacattcggtgat tccttttgcaagtcatttggatcatatta atgatgatggctccttgaatgaacaacttaa cagatataccggttattccaccggtgcctac |

TABLE 19-continued

Protein and DNA sequences of amylases used to build CBP strains.

| Seq# | Seq Name | Gene Source | Protein | DNA |
|---|---|---|---|---|
| | | | | tctttgacatggagcagtggtgctcttcttg aagctattagacttagaaataaggtcaaggc tttggcttaa |
| 4 | AE9 | Gene was codon optimized for S. cerevisiae and synthetized by GeneArt (PubMed#CAC83969.1) | MIRLTVFLTAVFAAVA SCVPVELDKRNTGHFQ AYSGYTVARSNFTQWI HEQPAVSWYYLLQNID YPEGQFKSAKPGVVVA SPSTSEPDYFYQWTRD TAITFLSLIAEVEDHS FSNTTLAKVVEYYISN TYTLQRVSNPSGNFDS PNHDGLGEPKFNVDDT AYTASWGRPQNDGPAL RAYAISRYLNAVAKHN NGKLLLAGQNGIPYSS ASDIYWKIIKPDLQHV STHWSTSGFDLWEENQ GTHFFTALVQLKALSY GIPLSKTYNDPGFTSW LEKQKDALNSYINSSG FVNSGKKHIVESPQLS SRGGLDSATYIAALIT HDIGDDDTYTPFNVDN SYVLNSLYYLLVDNKN RYKINGNYKAGAAVGR YPEDVYNGVGTSEGNP WQLATAYAGQTFYTLA YNSLKNKKNLVIEKLN YDLYNSFIADLSKIDS SYASKDSLTLTYGSDN YKNVIKSLLQFGDSFL KVLLDHIDDNGQLTEE INRYTGFQAGAVSLTW SSGSLLSANRARNKLI ELL | atgatcagattgaccgttttcttgaccgctg ttttgctgctgttgcttcttgtgttccagt tgaattggataagagaaacaccggtcatttc caagcttattctggttataccgttgctagat ctaacttcacccaatggattcatgaacaacc agctgtttcttggtactacttgttgcaaaac atcgattacccagaaggtcaattcaaatctg ctaaaccaggtgttgttgttgcttctccatc tacatctgaaccagattacttctaccaatgg actagagataccgctattaccttcttgtcct tgattgctgaagttgaagatcattctttctc caacactaccttggctaaggttgtcgaatat tacatttccaacacctacaccttgcaaagag tttctaatccatccggtaacttcgattctcc aaatcatgatggtttgggtgaacctaagttc aacgttgatgatactgcttatacagcttctt ggggtagaccacaaaatgatggtccagcttt gagagcttacgctatttctagatacttgaac gctgttgctaagcacaacaacggtaaattat tattggccggtcaaaacggtattccttattc ttctgcttccgatatctactggaagattatt aagccagacttgcaacatgtttctactcatt ggtctacctctggttttgatttgtgggaaga aaatcaaggtactcattcttcaccgctttg gttcaattgaaggctttgtcttacggtattc cattgtctaagacctacaatgatccaggttt cacttcttggttggaaaaacaaaaggatgcc ttgaactcctacattaactcttccggtttcg ttaactctggtaaaaagcacatcgttgaatc tccacaattgtcatctagaggtggtttggat tctgctacttatattgctgccttgatcaccc atgatatcggtgatgatgatacttacacccc attcaatgttgataactcctacgttttgaac tccttgtattacctattggtcgacaacaaga acagatacaagatcaacggtaactacaaagc tggtgctgctgttggtagatatcctgaagat gtttacaacggtgttggtacttctgaaggta atccatggcaattggctactgcttatgctgg tcaaacttttacaccttggcctacaattcc ttgaagaacaagaagaacttggtcatcgaaa agttgaactacgacttgtacaactccttcat tgctgatttgtccaagattgattcttcctac gcttctaaggattcttttgactttgacctacg gttccgataactacaagaacgttatcaagtc cttgttgcaattcggtgactcattcttgaag gttttgttggatcacatcgatgacaacggtc aattgactgaagaaatcaacagatacaccgg ttttcaagctggtgcagtttctttgacttgg tcatctggttctttgttgtctgctaatagag ccagaaacaagttgatcgaattattg |
| 5 | AE10 | Gene was codon optimized for S. cerevisiae and synthetized by GeneArt (PubMed#CAF31354.1) | MIWLKLSLYSLAFALF ADAAPVSSGEEAETSS STSSSAPAQITVDNEL TLGVSQVPNIVNKTAI DANEAAKGYDLVNVTT TAKGLTGILKLNEATN IYGYDFDYLNLSVEYQ SDDRLNVHIEPVDTDN VFILPESLVAKPSADD GDKIESFHFGGSSDLV FEYSSKNFGFEILRKS TGKSIFSTIGNPLVFS NQFIQFNTSLPKDHFI TGLGESIHGFRNEPGI VKTLYANDIANPIDGN IYGVHPFYIDQRFDTN ATHGVYWRTSAIQEVA VGNESLTWRALSGIVD LYFFSGPKPKDVIQQY VKEVGLPTFQPYWALG | atgatctggttgaagttgtccttgtactctt tggcttttgctttgtttgctgatgctgctcc agttctcttggtgaagaagctgaaacttct agtgagtactcttcatctgctccagctcaaa ttaccgttgataacgaattgaccttgggtgt ttctcaagttccaaacatcgttaacaagacc gctattgatgctaatgaagctgcaaaggtt acgatttggttaacgttactactactgctaa gggtttgaccggtattttgaagttgaatgaa gccactaacatctacggttacgatttcgatt acttgaacttgtccgtcgaatacccaatccga tgatagattgaacgttcacatcgaaccagtt gataccgataacgttttcattttgccagaat ccttggttgctaaaccatctgctgatgatgg tgataagatcgaatcttttcattttcggtggt tcctccgatttggttttgaatactcttcca agaacttcggtttcgaaatcttgagaaagtc taccggtaagtctatttttctccactattggt aacccattggttttctccaatcaattcatcc aattcaacacatccttgccaaaggatcatt |

TABLE 19-continued

Protein and DNA sequences of amylases used to build CBP strains.

| Seq# | Seq Name | Gene Source | Protein | DNA |
|---|---|---|---|---|
| | | | YHQCRWGYDTIEELDE VVENFKNFDIPLETIW SDIDYMDSYKDFTNDP HRYPLEKYQQFLDKLH ENNQHYVPIIDAAIYV PNPENATDNDYDVFHY GNETDVFLKNPDGSLY IGAVWPGYTVFPDFLS ENIQKYWTKVFKDWYQ QIKFDGIWLDMNEVSS FCVGSCGSGKITDNPV HPPFAVGGEATEFPEG FNKTNGTEYASFTSSL AAASPTSDEDSSASST SASIDSLNTLAPGKGN INYPPYAINNDQGDHD LATHAVSPNATHQDGT LEYDVHNLYGYLETNA TFEALLEIQPNKRPFI ISRSSFAGSGRQTGHW GGDNYSQFRSAYFSIA QAFSFGLSGIPFFGAD VCGFNGNSDYELCSRW MQLGSFFPFYRNHNIL GAISQEPYVWESVTEA TKTSMQIRYLLLPYYY TLLHEAHITGIPILRA FAWQFPPENKNVSTVDT QFFVGDALVVTPALEQ GVDTVKGTFPGSGNEE VYYDWYTHEKQNFTDG KNETLQAPLGHIPLHI RGGHILPTQEPAYTTT ESRQNPWGLIVALDKD GKAEGKLYSDDGESYE VEESLFVNFIASDNTL LSTSYGEYEVEQPLAN ITILGVENKPKEVKFD DSKVDFTFENNTIFVT GLDDQTEDGAFAKHFK LSW | cattactggtttgggtgaatccatccatggt tttagaaatgaaccaggtatcgtcaaaacct tgtacgctaatgatattgccaacccaatcga tggtaatatctatggtgttcacccattctac atcgataaagatttgataccaacgctaccc atggtgtttattggagaacttctgccattca agaagttgctgttggtaacgaatccttgact tgggagagctttgtctggtatagttgacttgt acttttctccggtccaaaacctaaggatgt cattcaacaatacgtcaaagaagttggtttg ccaacttttcaaccatattgggctttgggtt accatcaatgtagatggggttacgataccat cgaagaattggatgaagtcgtcgaaaacttc aagaacttcgatattccattggaaaccatct ggtccgatatcgattacatggattcctacaa ggatttcaccaacgatccacatagataccca ttggaaaagtaccaacaattcttggacaagt tgcacgaaaacaatcaacactacgttccaat tattgatgccgctatctacgttccaaatcca gaaaatgctaccgataacgattacgatgttt tccattacggtaacgaaaccgacgtttttt gaagaatccagatggttccttgtacattggt gctgtttggccaggttatactgttttccag atttcttgtccgaaaacatccaaaagtactg gaccaaggttttcaaggactggtatcaacaa atcaagttcgatggtatctggttggatatga acgaagttcttctttctgtgttggttcttg tggttctggtaagattactgataacccagtt catccacctttgctgttggtggtgaagcta tctgaatttccagaaggtttcaacaagacca acggtactgaaacgcttctttcacttcttct ttggctgctgcttctccaacttctgatgaag attcttctgcttcttctacctctgcttctat tgattctttgaacactttggctccaggtaag ggtaatattaactatccaccatacgccatca acaacgatcaaggtgatcatgatttggctac tcatgctgttttctccaaatgctactcatcaa gatggtactttggaatacgatgtccataact tgtacggttacttggaaactaacgctacttt cgaagccttgttggaaatccaacctaacaaa agaccattcatcatctccagatcttcatttg ctggttctggtagacaaactggtcattgggg tggtgataattactctcaattcagatctgcc tacttctctattgctcaagcttttctcttcg gtttgtccggtattccatttttggtgctga tgtttgtggtttcaacggtaattccgattac cgaattgtgttccagatggatgcaattgggt tcattttccattctacagaaaccacaacat tttgggtgccatttctcaagaaccatacgtt tgggaatctgttactgaagctactaagacct ccatgcaaatcagatatttgttgttgcctta ctactacaccttgttgcatgaagctcatatt accggtatcccaattttgagagcttttgctt ggcaattcccagaaaacaagaacgtttctac cgttgatacccaattctttgttggtgatgct ttggttgttactccagctttggaacaaggtg ttgatactgttaagggtactttccaggttc tggtaacgaagaagtttactacgattggtac acccacgaaaagcaaaatttcactgacggta agaacgaaacattgcaagctccattgggtca tattccattgcatattagaggtggtcatatc ttgccaactcaagaaccagcttacactacta ctgaatctagacaaaatccatggggtttgat agttgccttggataaggatggtaaagccgaa ggtaaattatactccgatgatggtgaatcct acgaagttgaagaatccttgttcgttaacttt cattgcttccgataataccttgttgtctacc tcttacggtgaatatgaagtcgaacaaccat tggccaacattactattttgggtgttgaaaa caagccaaaagaagttaagttcgacgattcc aaggttgatttcaccttcgaaaacaacacca ttttcgttaccggtttggatgatcaaactga agatggtgcttttgctaagcactttaagttg tcttgg |

Example 24

Evaluation of CBP Strains Performance on Raw Corn Mash

Figure 53:
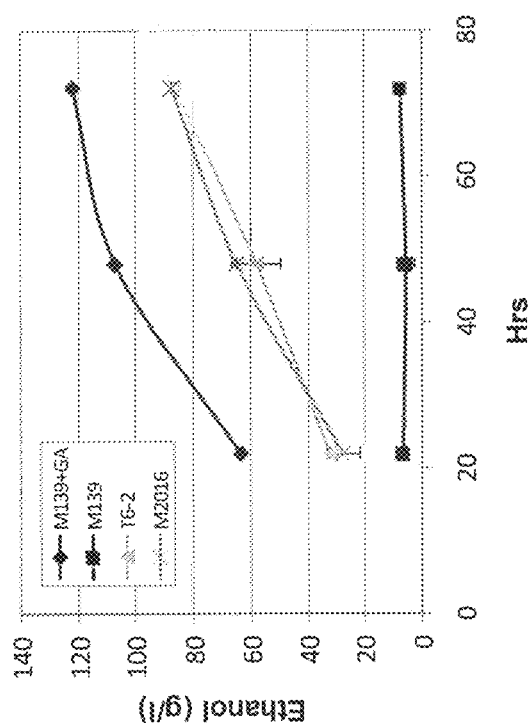
FIG. 53 depicts ethanol produced by amylolytic yeast without exogenous glucoamylase from non-liquefied corn mash. 50 g flask runs on raw starch (corn ground w/2 mm screen Wiley Mill); raw corn slurry 30% solids; 0.006 mg/ml Pen G: 0.1 gDCW/l inoculum; T=35° C. for 24 hrs followed by 32° C. Average of duplicate flasks shown. The fermentations were performed using 500 ppm urea as the only nutrient source.

The performance of selected CBP strains was also evaluated by fermentation of non-liquefied corn starch (FIG. 53). FIG. 53 demonstrates that even though the sets of enzymes expressed in those CBP strains were not optimized for this substrate, over 80 g/l ethanol was produced by CBP strains from raw mash in 72 h without any exogenous enzymes.

Example 25

Improving Strain Performance by Evolution

Yeast is known for its ability of adjustment to very broad range of conditions. This property could be used to increase yeast ethanol and high temperature resistance and improve performance (ethanol yield) at certain relevant conditions such as during fermentation of corn mash. To explore this possibility as a tool to develop better CBP yeast strains that are able to reach higher ethanol yield, one of the best CBP strains M1973 was evolved by using serial transfer in corn mash. Serial transfer fermentations were carried out using shake flasks containing 35% TS liquefied corn mash with industrial medium grown at 35° C. and 150 rpm. At 3 days intervals, 10 ml were transferred to fresh medium of the same composition (5 transfers). At each transfer starting with the second the temperature was raised 1 degree. At the last transfer it was 38° C. After 5 transfers (~500 hours), the cell were plated on YPD plates for evaluation. The evolved strain was evaluated by fermentation on liquefied corn mash at two different temperatures (32° C. and 35° C.) and two different concentrations of solids (30% and 35%). Original M1973 strain from the freezer stock was used as control (FIG. 54). FIG. 53 demonstrates that at all conditions tested adapted M1973 strain was able to produce more ethanol than parental M1973 at 48 hrs. Therefore evolution of yeast strains was proven to be a powerful tool for developing better strains.

Example 26

Process Flow Sheet with CBP Strains

The example of CBP process in presented on FIG. 55. In this example two yeast CBP strains are used in the process and cultured separately, S1 and S2. Liquefied corn pre-treated with alpha-amylases is fermented by yeast strain S1. S1 has optimal set of amylases and accessory enzymes engineered to efficiently convert corn starch into glucose without any exogenous enzymes added. After ethanol distillation the stillage is being pre-treated and fermented by strain S2. S2 has cellulolytic set of enzymes engineered and optimized for corn fiber conversion as well as xylose and arabinose pathways. S2 also has amylolytic enzymes engineered because more starch is being released while corn fiber pretreatment. Ground raw corn mash could also be utilized. In this case no alpha-amylase pre-treatment is necessary and alpha-amylase could be expressed by strain S1.

Example 27

Screening and Characterization of Industrial Yeast Strains

The objective of this study was finding an industrial host that will combine high temperature/ethanol tolerance and high heterologous protein secretion. Several industrial yeast strains were obtained from various commercial sources (Table 20). In order to better understand the strains' relations with each other, all strains were genotyped as described by Ness et al., 1993 (FIG. 56). The similarity between band patterns or genotyping patterns reflects strain's genetic similarity. Most of strains demonstrated one of 2 genotyping patterns. One pattern was similar to M0139 and other was similar to M2390. The pattern of M2392 was different from others.

The industrial strains were compared for their ability to grow at high temperature (FIG. 57). FIG. 57 shows that the strains demonstrated significantly different growth at 41° C. The same pattern was confirmed when 41° C. maximum growth rate in YPD was measured quantitatively by plate reader (FIG. 58, top). The strains were also tested for robustness—maximum ethanol titer reached on high solids with full enzyme dose (FIG. 58, bottom). A comparison of the maximum growth data 41° C. with robustness data reveals that there is a positive correlation between high temperature tolerance and high ethanol tolerance. Therefore, the ability of strains to reach high ethanol titers could be estimated by their 41° C. maximum growth rate in high throughput format. The data shown in FIGS. 56 and 58 are summarized in Table 21. The data in Table 21 demonstrate that strains from ethanol industry (genotyping pattern B) tend to have higher ethanol and high temperature tolerance compared to wine strains (genotyping pattern A).

In order to compare ability of industrial strains to express heterologous proteins, the host strains from Table 20 were transformed with the same expression construct of AE9—*Saccharomycopsis fibuligera* glucoamylase gene (Accession No. CAC83969.1). Four copies of AE9 were directly integrated into FCY locus. FCY was used as negative marker. The construct used was similar to the one used for M2016 construction (Example 23). The map of the expression construct used in this experiment shown on FIG. 60. Several transformants for each host were picked and screened for starch activity (FIG. 59). Different host strains demonstrated different ability to secrete GA. Interestingly, two batches of the same strain, M0212 and M2390, had different average expression level of the same AE9 expression construct. Thus, it was demonstrated that robust ethanol tolerant hosts from ethanol industry like M2390 can be suitable host for engineering CBP strains.

Transformants for each host that were the most active on starch (Table 22) were tested in shake flask fermentation on raw corn flour and conventional corn mash together with non-transformed hosts (FIG. 61-62). FIGS. 61 and 62 demonstrate that both host strains M0212 and M2390 and their GA transformants, M2395 and M2399, have superior performance on both tested substrates compared to other tested industrial strains. M2390 had higher average GA expression/secretion level than M0212 and therefore was chosen as the host to engineer CBP strains.

TABLE 20

Industrial ethanologen strains used in the study.

| Mascoma# | Strain name | Producer | Reference |
|---|---|---|---|
| M139 | N96 | Anchor wine yeast | http://www.anchorwineyeast.com/pdf/N_96.pdf |

TABLE 20-continued

Industrial ethanologen strains used in the study.

| Mascoma# | Strain name | Producer | Reference |
|---|---|---|---|
| M212 | Ethanol Red (old) | LaSaffre | http://www.lesaffreyeastcorp.com/home/ |
| M2390 | Ethanol Red (new) | LaSaffre | http://www.pahc.com/Phibro/Performance-Products/Catalog/23/Ethanol-Red.html |
| M2394 | FALI | ABMauri | http://www.alcoholyeast.com/downloads/doc1.pdf |
| M2393 | Premier Cuvee | LaSaffre | http://mountainhomebrew.com/premiercuvee-5grampackage.aspx |
| M2392 | Lalvin ICV-K1 (V1116) | Lallemand | http://www.lalvinyeast.com/images/library/ICV-K1_Yeast.pdf |
| M2391 | Lalvin EC-1118 | Lallemand | http://store.homebrewheaven.com/lalvin-ec-1118-champagne-wine-yeast-p1076.aspx |
| M2507 | NABC Bio-Ferm XR | North America Bioproducts | http://www.na-bio.com/index.php?option=com_content&view=article&id=74&Itemid=263 |

TABLE 21

Summary of industrial strains screening. The summary is based on the data shown on FIGS. 56 and 58.

| Mascoma# | Main application | Genotyping pattern | 41 C growth rate | EtOH on flour g/l |
|---|---|---|---|---|
| M0139 | Wine | M130 like | 0.03 | 132 |
| M0212 | Ethanol | M212 like | 0.21 | 141 |
| M2390 | Ethanol | M212 like | 0.16 | 143 |
| M2394 | Ethanol | M212 like | 0.17 | 143 |
| M2393 | Wine | M139 like | 0.03 | 132 |
| M2392 | Wine | New | 0.08 | 124 |
| M2391 | Wine | M139 like | 0.18 | 146 |
| M2507 | Ethanol | M212 like | 0.35 | 147 |

TABLE 22

Industrial strains transformed with 4 copies of *Saccharomycopsis fibuligera* glucoamylase gene (NCBI#CAC83969.1) and their most active on starch transformants selected by starch assay (FIG. 59). Strain M2111 was made the same way as M2016, only more colonies (84) were screened by starch assay. Several the most active colonies were screened by industrial corn mash fermentation and the best performing strain was named M2111.

| Host strain | Transformant |
|---|---|
| M139 | M2400, M2111 |
| M212 | M2399 |
| M2390 | M2395 |
| M2394 | M2398 |
| M2393 | M2397 |
| M2391 | M2396 |

Example 28

Increasing Heterologous GA Production by High Ethanol/Temperature Tolerant Yeast Strain The objective of this study was engineering ethanol/temperature tolerant industrial yeast strain expressing high level of heterologous glucoamylase. The strain M2111 was made the same way as M2016 (Example 23), only more colonies (84) were screened by starch assay. Even though it was demonstrated that ethanologen M2390 host has much higher ethanol/temperature tolerance compared to wine strain M0139 and performs significantly better at high solids or high temp conditions when supplemented with high dose of exogenous enzyme (Example 28), M2111 transformant derived from M0139 (Table 22) has much higher AE9 secretion level compared to M2395 derived from robust M2390 (FIG. 63). Due to high level GA production, M2111 was reaching higher ethanol titer at lower solids and lower temperature fermentations without exogenous enzyme added compared to M2395. Therefore it was necessary to increase GA production by M2390 host in order to improve CBP performance—maximum ethanol reached at low or no exogenous enzyme added. There is a significant activity variation between transformants even when obtained with directed integration. Therefore screening more transformants usually yields strains with higher expression level. Only several transformants were screened when M2395 was selected. In order to increase AE9 expression level in M2390 host. M2390 was transformed with the same AE9 expression construct as was used to obtain strain M2016. The expression construct was integrated into FCY locus and FCY was used as negative selection. About 1000 transformants were screened for starch activity. Starch assay for the best 30 transformants was repeated in triplicates (FIG. 63). Several transformants demonstrated activity similar to M2111 and much higher than M2395.

Seventeen of the most active transformants were screened for CBP performance by minivial fermentation assay with corn flour and homemade mash (FIGS. 64-65). The advantage of new robust background was especially noticeable in corn flour fermentation experiment. The new strains demonstrated significantly better performance compared to less robust M2111 strain and reached higher ethanol titers. Several best strains were further analyzed by shake flask corn flour fermentation (FIG. 66). Results of shake flask fermentation confirmed ability of new robust CBP strains to reach above 140 g/l ethanol on 33% corn flour with 6 times less exogenous enzyme added compared to standard raw corn flour process.

Time course fermentation of conventional mash (FIG. 67) and raw corn flour (FIG. 68) was performed for one of the best M2390+AE9 transformant—M2691 strain (P10-19). Untransformed host M2390 was used as a control in both experiments. On corn mash, M2691 was fermented without any exogenous enzymes added, while standard (for corn mash process) dose of commercial glucoamylase (0.3AGU/g solids) was added to the control M2390. On corn flour, standard for raw substrate GA dose (0.6AGU/g) was added to the M2390 and 6 times less enzyme was added to GA expressing M2691 strain. FIG. 67 demonstrates that in conventional liquefied corn mash fermentation process genetically engineered GA producing strain is able to provide complete CBP and reach above 125 g/l ethanol at 72 hours. To our knowledge, this is the first time demonstration of high industrially relevant ethanol titers reached by genetically engineered strain without any exogenous enzymes added. FIG. 68 demonstrates that on raw corn substrate GA producing strains can reach even higher ethanol titer (above 140 g/L at 72 h) which is a standard for raw corn flour fermentation industry. Small dose of exogenous enzyme still needs to be added to the engineered strain to provide optimal fermentation, but amount of exogenous enzyme added can be decreased several fold.

Example 28

Increasing Heterologous GA Production Effects Exogenous Enzyme Dose Reduction

FIG. 69 demonstrates how amount of GA heterologously produced by yeast strains effects exogenous enzyme dose reduction. Three strains were used for this experiment: untransformed M2390, low GA producer M2395, and high GA producer M2519 (P6-65). The strains were fermented on corn flour in shake flasks with different dose of GA added. Standard corn flour industrial GA dose of 0.6AGU/g solids was counted as 100%. This data clearly demonstrate that amount of GA produced by yeast strain has significant effect on exogenous GA dose reduction. For the specific exogenous GA used (Spirizyme Ultra) there was at least 75% dose reduction due to heterologously expressed GA by M2519 strain. Furthermore, at the end of fermentation there was extra glucose present with GA producing strains. It was shown in other experiments that this glucose can be transformed into additional ethanol yield at 100% exogenous enzyme dose if fermentation of corn flour performed at lower 33% solids.

Example 29

Stability of Glucoamylase Expression

Stability of GA expression was tested for several M2390+ AE9 strains. Data for strains M2519 and M2691 are shown in FIG. 70. Strains were propagated in YPD, grown to stationary phase and passaged with 100× dilution 11 times (1 passage equals about 9 generations). Several samples between passages were stocked. All samples and original strain were plated and inoculated in YPD together. Then activity on starch for all samples was measured in the same starch assay. Out of nine strains tested only three lost some activity (10-50%). Majority of the strains retained 100% of their amylolytic activity for up to 99 generations. This data indicated that most of strains built by directed integration are genetically stable.

Example 30

Screening Saccharolytic Genes for Functional Expression in Yeast

Multiple genes encoding for saccharolytic enzymes were screened for functional expression in yeast (Table 23). The genes were either synthesized by GeneArt (now Life Technologies) or isolated by PCR from genomic DNA. Some genes were expressed with native signal sequences and in others native signal sequence was replaced by *S. cerevisiae* invertase signal sequence. Some synthetic genes were codon optimized for expression in *S. cerevisiae* (by GeneArt) and others were synthesized with native DNA sequence. All genes were expressed under ENO1 promoter and terminator from 2-micron plasmid pMU1575. The genes were inserted between PacI/AscI sites of pMU1575 either by cloning or yeast mediated ligation. Expression contracts were transformed into an industrial background Mascoma strain M1744 and selected on minimal URA deficient media. Transformants were grown in YPD for 3 days and supernatants were analyzed for activity on starch, pullulan, xylan, pNPX (xylosidase activity), maltose and pectin (FIG. 71). The assays for each enzyme were chosen based on predicted activity. The enzymes that demonstrated secreted activity in one or more assays are highlighted in Table 23. FIG. 71 shows results of pullulan, xylan and pectin assays for some enzymes. Isopullulanase SE35 was active on pullulan. Five xylanases were active on xylan and three pectin lyases were active on pectin. Pullulanase SE41 had slight secreted activity on pullulan. Glucoamylase AE82 had some secreted activity on starch and maltose.

TABLE 23

Genes analyzed for functional expression in yeast. For most genes protein sequence was obtained from NCBI database. For genes marked with "*" DNA gene sequence was obtained from Mascoma *Thermoanaerobacterium saccharolyticum* genome sequence data.

| ID | Organism | Source | Enzyme | NCBI# | Gene | Signal sequence | Codon optimization |
|---|---|---|---|---|---|---|---|
| SE12 | Fungi | Aspergillus oryzae | Glucoamylase | BAA01540.1 | Synthetic | Native | None |
| SE13 | Fungi | Rhizopus oryzae | Glucoamylase | BAA00033.1 | Synthetic | Native | None |
| SE28 | Fungi | Aspergillus niger | Xylosidase Arabinofuranosidase | CAK39870.1 | Synthetic | Native | None |
| SE32 | Fungi | Aspergillus niger | Xylanase | AAS46914.1 | Synthetic | Native | None |
| SE33 | Fungi | Aspergillus niger | Xylanase | AAS46913.1 | Synthetic | Native | None |
| SE34 | Fungi | Aspergillus niger | Xylanase | CAA03655.1 | Synthetic | Native | None |
| SE35 | Fungi | Aspergillus niger | Isopullulanase | BAA19473.1 | Synthetic | Native | None |
| SE37 | Fungi | Aspergillus niger | Endopolygalacturonase | XP_001389562.1 | Synthetic | S.c. Invertase | S. cerevisia |
| SE38 | Fungi | Aspergillus niger | Endopolygalacturonase | CAK42510.1 | Synthetic | S.c. Invertase | S. cerevisia |
| SE41 | Plant | Zea mays | Pullulanase | NP_001104920.1 | Synthetic | S.c. Invertase | S. cerevisia |
| SE42 | Plant | Oryza sativa | Pullulanase | ACY56113.1 | Synthetic | S.c. Invertase | S. cerevisia |
| SE43 | Plant | Zea mays | Isoamylase | ACG43008.1 | Synthetic | S.c. Invertase | S. cerevisia |
| SE47 | Fungi | Humicola insolens | Xylanase | CAA53632.1 | Synthetic | Native | None |
| SE48 | Fungi | Talaromyces emersonii | Xylanase | CAD34597.1 | Synthetic | Native | None |
| SE49 | Fungi | Trichoderma viride | Xylanase | AAQ67413.1 | Synthetic | Native | None |
| SE50 | Plant | Triticum aestivum | Pullulanase | ABL84490.1 | Synthetic | S.c. Invertase | S. cerevisia |

TABLE 23-continued

Genes analyzed for functional expression in yeast. For most genes protein sequence was obtained from NCBI database. For genes marked with "*" DNA gene sequence was obtained from Mascoma *Thermoanaerobacterium saccharolyticum* genome sequence data.

| ID | Organism | Source | Enzyme | NCBI# | Gene | Signal sequence | Codon optimization |
|---|---|---|---|---|---|---|---|
| SE51 | Yeast | *Saccharomyces cerevisiae* | Endopolygalacturonase | NP_012687.1 | Native | Native | |
| SE52 | Yeast | *Kluyveromyces marxianus* | Endopolygalacturonase | AAR84199.1 | Native | Native | |
| SE53 | Bacteria | *Bacillus subtilis* | Pectin lyase | NP_389746.1 | Native | S.c. Invertase | |
| SE54 | Bacteria | *Bacillus licheniformis* | Polygalacturonase | YP_080606.1 | Native | S.c. Invertase | |
| SE55 | Bacteria | *Bacillus licheniformis* | Pectin lyase | YP_079258.1 | Native | S.c. Invertase | |
| SE56 | Fungi | *Aspergillus niger* | Endopolygalacturonase | CAB72125.1 | Synthetic | S.c. Invertase | S. cerevisia |
| SE57 | Fungi | *Aspergillus niger* | Endopolygalacturonase | CAB72126.1 | Synthetic | S.c. Invertase | S. cerevisia |
| SE58 | Fungi | *Aspergillus niger* | Endopolygalacturonase | XP_001390812.1 | Synthetic | S.c. Invertase | S. cerevisia |
| SE59 | Fungi | *Aspergillus niger* | Endopolygalacturonase | CAB72931.1 | Synthetic | S.c. Invertase | S. cerevisia |
| SE60 | Fungi | *Aspergillus niger* | Endopolygalacturonase | CAK44164.1 | Synthetic | S.c. Invertase | S. cerevisia |
| SE61 | Fungi | *Aspergillus niger* | Pectin lyase | CAK48529.1 | Synthetic | S.c. Invertase | S. cerevisia |
| SE62 | Fungi | *Aspergillus niger* | Pectin lyase | CAK37997.1 | Synthetic | S.c. Invertase | S. cerevisia |
| SE63 | Fungi | *Aspergillus niger* | Pectin lyase | AAW03313.1 | Synthetic | S.c. Invertase | S. cerevisia |
| SE64 | Fungi | *Aspergillus niger* | Pectin lyase | CAK47350.1 | Synthetic | S.c. Invertase | S. cerevisia |
| SE65 | Fungi | *Aspergillus niger* | Pectin lyase | ACE00421.1 | Synthetic | S.c. Invertase | S. cerevisia |
| AE11 | Yeast | *Lipomyces kononenkoae* | Alpha-amylase | AAC49622.1 | Synthetic | Native | None |
| AE79 | Yeast | *Arxula adeninivorans* | Glucoamylase | CAA86997.1 | Synthetic | Native | None |
| AE81 | Fungi | *Hormoconis resinae* | Glucoamylase | CAA48243.1 | Synthetic | Native | None |
| AE82 | Fungi | *Aureobasidium pullulans* | Glucoamylase | ADN65121.1 | Synthetic | S.c. Invertase | S. cerevisia |
| AE88 | Bacteria | *Thermoanaerobacterium saccharolyticum* | Polygalacturonase | Contig1 Gene or0164* | Native | S.c. Invertase | |
| AE84 | Bacteria | *Thermoanaerobacterium saccharolyticum* | Polygalacturonase | Contig1 Gene or0344* | Native | S.c. Invertase | |

Example 31

Identifying Enzymes and their Combinations that Increase Sugars Release from Industrial Corn Substrates Distiller corn syrup, which is a soluble fraction left from processing corn to ethanol, was one of the substrates used to identify enzymes that will allow releasing more sugars from corn mash. Corn syrup contains soluble oligosaccharides that are left undigested in corn mash hydrolysis/fermentation process. Several yeast-made enzymes were tested for conversion of corn syrup. Several enzymes: CBH1, CBH2, EG2, BGL, XYL, and XLD were purified by ion exchange and hydrophobic interaction chromatography on the FPLC from yeast supernatants (Table 24). For others yeast strains expressing enzymes were grown for 3 days in YPD and supernatants were used as enzyme source. Table 24 summarizes the information on enzymes used in this experiment. Supernatants of two enzymes were mixed in equal ratio by volume. Supernatants of single enzymes were mixed with supernatant of empty strain control M0139. FIG. 72 show the results of one of those assays. The experiment was done with and without yeast made glucoamylase (AE9). Table 25 shows how much of each purified enzyme was used in this corn syrup assay. Addition of some enzymes increased sugars release from corn syrup. AE9 itself had the biggest impact indicating that there is a lot of starch left undigested after corn mash processing. Other enzymes such as alpha-glucosidase, beta-glucosidase, acetyl xylan esterase (in combination with cellulases and hemicellulases) also gave essential increase in glucose release from corn syrup.

Based on this data, several genes were selected that have a potential to improve AE9 glucoamylase expressing strain M2111 due to increased sugar release from corn mash or corn flour. The selected genes are listed in Table 26. Other candidates in Table 26 were chosen based on a rational approach based on which enzymes may have effect on sugar release based on substrate structure (Saulnier et al., *Carbohydrate Polymers*, 26: 279-287, 1995). All genes selected demonstrated functional expression in yeast.

TABLE 24

Enzymes used in corn syrup assay (FIG. 24). All enzymes except AE9 were expressed on 2u plasmid under *S. cerevisiae* ENO1 promoter and terminator from 2-micron plasmid pMU1575. AE9 in M2111 was expressed from 4 gene copies integrated into chromosome (the same as in M2016). The genes were codon optimized for *S. cerevisiae* and synthesized by GeneArt. Yeast and fungal genes were expressed with native signal sequences. Bacterial gene was attached to *S. cerevisiae* Invertase signal sequence.

| ID | Strain | Source | Enzyme | Reference | Enzyme prep |
|---|---|---|---|---|---|
| CBH1 | | *Talaromyces emersonii* *Trichoderma reesei* | cellobiohydrolase I | WO/2010/060056 | HPLC purified |
| CBH2 | | *Chrysosporium lucknowense* | cellobiohydrolase II | WO/2010/060056 | HPLC purified |

TABLE 24-continued

Enzymes used in corn syrup assay (FIG. 24). All enzymes except AE9 were expressed on 2u plasmid under *S. cerevisiae* ENO1 promoter and terminator from 2-micron plasmid pMU1575. AE9 in M2111 was expressed from 4 gene copies integrated into chromosome (the same as in M2016). The genes were codon optimized for *S. cerevisiae* and synthesized by GeneArt. Yeast and fungal genes were expressed with native signal sequences. Bacterial gene was attached to *S. cerevisiae* Invertase signal sequence.

| ID | Strain | Source | Enzyme | Reference | Enzyme prep |
|---|---|---|---|---|---|
| EG2 | | *Trichoderma reesei* | endoglucanase II | WO/2010/060056 | HPLC purified |
| BGL | | *Saccharomycopsis fibuligera* | beta-glucosidase | WO/2010/060056 | HPLC purified |
| XYL | | *Clostridium phytofermentans* | Xylanase (BC60) | NCBI# YP_001558623.1 | HPLC purified |
| XLD | | *Pyrenophora tritici-repentis* | beta-xylosidase | NCBI# XM_001940921.1 | HPLC purified |
| NC | M139 | None | none | none | Supernatant |
| AE9 | M2111 | *Saccharomycopsis fibuligera* | Glucoamylase (AE9) | NCBI# CAC83969.1 | Supernatant |
| ABF | M1511 | *Aspergillus niger* | arabinofuranosidase | NCBI# AAA93264 | Supernatant |
| AXE | M1782 | *Trichoderma reesei* | acetylxylanesterase | NCBI# Q99034 | Supernatant |
| FAE | M1475 | *Aspergillus niger* | feruoyl esterase | NCBI# XP_001393337 | Supernatant |
| ARA | M2069 | *Bacillus licheniformis* | arabinase | NCBI# AAU41895.1 | Supernatant |
| AE10 | M1923 | *Saccharomycopsis fibuligera* | alpha-glucosidase | NCBI# CAF31354.1 | Supernatant |
| SE35 | M2614 | *Aspergillus niger* | isopullulanase | NCBI# BAA19473.1 | Supernatant |

TABLE 25

Amounts of purified enzymes used in corn syrup assay experiment (FIG. 72) in mg of enzyme per g of total solids.

| Protein | Load mg/g |
|---|---|
| CBH1 | 1.6 |
| CBH2 | 1.6 |
| EG2 | 0.6 |
| BGL | 0.2 |
| XYL | 0.4 |
| XLD | 0.2 |

TABLE 26

Enzymes selected to be expressed in M2111 strain alone or in combinations. SBD—starch binding domain.

| Gene ID | Source | Enzyme |
|---|---|---|
| AE1 | *Saccharomycopsis fibuligera* | alpha-amylase |
| AE3 | *Debaryomyces occidentalis* | alpha-glucosidase |
| AE5 | *Debaryomyces occidentalis* | alpha-amylase |
| AE7 | *Debaryomyces occidentalis* | alpha-amylase |
| AE8 | *Saccharomycopsis fibuligera* | glucoamylase |
| AE8 + SBD | *Saccharomycopsis fibuligera* *Aspergillus niger* | S.f.glucoamylase + SBD of A.n.glucoamylase (SE11) |
| AE9 | *Saccharomycopsis fibuligera* | glucoamylase |
| AE10 | *Saccharomycopsis fibuligera* | alpha-glucosidase |
| AE22 | *Clostridium phytofermentans* | pullulanase |
| AE73 (ARA) | *Bacillus licheniformis* | arabinase |
| SE20 | *Aspergillus niger* | beta-glucosidase |
| SE32 | *Aspergillus niger* | xylanase |
| SE33 | *Aspergillus niger* | xylanase |
| SE34 | *Aspergillus niger* | xylanase |
| SE35 | *Aspergillus niger* | isopullulanase |
| SE39 (ABF) | *Aspergillus niger* | arabinofuranosidase |
| SE47 | *Humicola insolens* | xylanase |
| SE48 | *Talaromyces emersonii* | xylanase |
| SE66 (AXE) | *Trichoderma reseei* | acetyl xylan esterase |
| SE67 (FAE) | *Aspergillus niger* | feruoyl esterase |
| BC60 (XYL) | *Clostridium phytofermentans* | xylanase |
| FAE2 | *Talaromyces stipitatus* | feruoyl esterase |

Example 32

Construction and Screening of Improved Amylolytic Strains

To make a transformation host for additional AE9 saccharolytic enzymes expression, URA3 was knocked out of M2111 and the resulting M2125 strain was used as a host for transformations. For each enzyme from Table 26 integrative expression cassette was built targeting delta sites on chromosome. URA3 gene was used as autotrophic selection marker. Each gene of interest under control of *S. cerevisiae* strong constitutive promoter and terminator was inserted between URA3 and Delta2 fragments of pMU2382 vector digested with BamHI and EcoRI (FIG. 73). The expression cassette was inserted by yeast mediated ligation in the same orientation as URA3. The fragment that includes delta sites, URA3 and expression cassette was isolated by PCR or restriction digest and transformed into M2125. Some enzymes were transformed individually and others were transformed in combinations. When more than one gene was transformed, different DNA fragments were mixed in equal ratio (total DNA amount the same as for single genes, about 1 µg). For each transformation about 100 colonies were picked (one 96 wp) and pre-screened by specific assays (for example, xylan assay for xylanases integrated, starch assay for alpha-amylases). Consequently several of the most active transformants were assayed by corn flour assay and screened for increased sugars release. For each assay, transformants were grown in YPD for 3 days and supe was assayed. The example of secondary corn flour assay is shown on FIG. 74. FIG. 74 shows that many transformants demonstrated activity above parental M2111 strain. The transformations screened in this experiment are described in the Table 27.

Transformers that released the most sugars in corn flour assay (highlighted in FIG. 74) were selected for screening by fermentation. First strains were pre-screened by minivial fermentation assay on two substrates: homemade corn mash and raw corn flour. Homemade mash and corn flour were picked as screening substrates because they allow better discrimination between different strains (tougher substrate), while industrial corn mash is too digestible to allow noticing the small differences between strains. Each substrate generated different groups of the best performers. The only strains that seemed to perform well on both substrates were strains with AE7 (*Debaryomyces occidentalis* alpha-amylase) integrated. The next step of screening was scaled up to shake flasks and also was done on the same two substrates, but different sets of strains were used for each substrate depending on performance in minivials assays. The results of shake flask screening experiments are shown on FIGS. 75 and 76. FIGS. 75 and 76 show that several different saccharolytic genes and their combinations had positive effect on ethanol titer. Confirming the minivials assay results, AE7 had positive effect on both substrates.

Remaking the M2111 strain was attempted in order to increase AE9 production. It was noticed that there is a significant activity variation between transformants even when obtained with directed integration. Therefore, screening more transformants usually yields strains with higher expression level. Only 84 transformants were screened when M2111 was selected. In order to increase AE9 expression level, M139 was transformed with the same AE9 expression construct as was used for making the M2111 strain. The expression construct was integrated into FCY locus and FCY was used as negative selection. About 1000 transformants were screened for starch activity. Several transformants demonstrated activity higher than M2111. Several of the most active on starch transformants were screened by minivials fermentation assay on homemade mash and raw corn flour. Some transformants had higher EtOH yield compared to M2111, on raw corn flour. In the follow up experiment, several best strains were screened in shake flask fermentation on the same two substrates (FIG. 77). This experiment confirmed that strains with higher activity on starch reach higher ethanol titers on corn flour. On homemade mash there is no significant difference comparing to M2111. The performance difference on flour could be due to higher secretion level of AE9. To test this hypothesis, several of the best strains were inoculated and grown in YPD for 3 days. AE9 was measured by HPLC. The protein data was plotted in FIG. 77 together with EtOH data. The correlation between AE9 level production and EtOH yield was found for corn flour fermentation and there is no such correlation for homemade mash. This data indicate that on corn flour the strains are still GA limited, while on homemade mash they are not.

The best performing strains that came out of screening on homemade mash and raw corn flour were also tested on industrial corn mash (FIGS. 78 and 79) which is the most commercially relevant substrate for this application (used in majority of commercial corn ethanol facilities). The best strains from that screen are summarized in Table 34.

TABLE 27

Transformations ID (T) for corn flour activity assay data from FIG. 74. *S. cerevisiae* promoter used with each gene shown in parentheses.

| Transformation# | Genes transformed |
| --- | --- |
| 1 | AE8 (TEF2p) |
| 2 | AE9 (ADH1p) |
| 3 | AE10 (FBA1p) |
| 4 | AE7 (ENO1p) |
| 5 | AE1 (ADH1p) |
| 6 | AE1 (TEF2p) |

TABLE 27-continued

Transformations ID (T) for corn flour activity assay data from FIG. 74. *S. cerevisiae* promoter used with each gene shown in parentheses.

| Transformation# | Genes transformed |
| --- | --- |
| 7 | AE8 + SBD (ENO1p) |
| 8 | BC60 (ADH1p) |
| 9 | ARA (ENO1p) |
| 10 | BC60 (ADH1p) + ABF (ENO1p) |
| 11 | BC60 (ADH1p) + AXE (ENO1p) |
| 12 | BC60 (ADH1p) + FAE1 (PFK2p) |
| 13 | BC60 (ADH1p) + FAE2 (PYK1p) |
| 14 | BC60 (ADH1p) + FAE1 (ENO1p) |
| 15 | SE32 (ENO1p) |
| 16 | SE33 (ENO1p) |
| 17 | SE34 (ENO1p) |
| 18 | SE35 (ENO1p) |
| 19 | SE47 (ENO1p) |
| 20 | SE48 (ENO1p) |
| 21 | SE35 (ENO1p) + AE8 (TEF2p) |
| 22 | SE35 (ENO1p) + AE10 (FBA1p) |
| 23 | SE35 (ENO1p) + AE7 (ENO1p) |
| 24 | SE35 (ENO1p) + BC60 (ADH1p) + ARA (ENO1p) |
| 25 | SE32 (ENO1p) + ABF (ENO1p) + AXE (ENO1p) |
| 26 | SE34 (ENO1p) + ABF (ENO1p) + AXE (ENO1p) |
| 27 | SE35 (ENO1p) + AE8 (TEF2p) + AE7 (ENO1p) + AE10 (FBA1p) |
| 28 | AE8 (TEF2p) + AE10 (FBA1p) + AE1 (ADH1p) |
| 29 | Empty vector control |
| 30 | No DNA control |
| 55 | BC60 (ADH1p) + ARA (ENO1p) |

TABLE 28

Strains expressing additional to AE9 saccharolytic enzymes selected for screening on corn mash in shake flasks (FIG. 75).

| # | Strain ID | Strain description |
| --- | --- | --- |
| 1 | T4-8 | M2111 + AE7 |
| 2 | T4-1 | M2111 + AE7 |
| 3 | T5-88 | M2111 + AE1 |
| 4 | b | M2111 + AE1 + AE8 + AE10 |
| 5 | d | M2111 + AE1 + AE8 + AE10 |
| 6 | i | M2111 + AE1 + AE8 + AE10 |
| 7 | o | M2111 + AE1 + AE8 + AE10 |
| 8 | r | M2111 + AE1 + AE8 + AE10 |
| 9 | M2111 | Control |
| 10 | M139 | Control |

TABLE 29

Strains expressing additional to AE9 saccharolytic enzymes selected for screening on corn flour in shake flasks (FIG. 76).

| # | Strain ID | Strain description |
| --- | --- | --- |
| 1 | T2-6 | M2111 + AE9 |
| 2 | T11-32 | M2111 + BC60 + SE66 |
| 3 | T18-11 | M2111 + SE35 |
| 4 | T5-88 | M2111 + AE1 |
| 5 | T4-8 | M2111 + AE7 |
| 6 | b | M2111 + AE1 + AE8 + AE10 |
| 7 | i | M2111 + AE1 + AE8 + AE10 |
| 8 | p | M2111 + AE1 + AE8 + AE10 |
| 9 | M2111 | Control |
| 10 | M139 | Control |

TABLE 30

Strains expressing AE9 selected for screening on homemade corn mash in shake flasks (FIG. 77, top).

| # | Strain ID | Strain description |
|---|-----------|--------------------|
| 1 | P4-19 | M139 + AE9 |
| 2 | P8-60 | M139 + AE9 |
| 3 | P11-67 | M139 + AE9 |
| 4 | P12-65 | M139 + AE9 |
| 5 | P12-17 | M139 + AE9 |
| 6 | M2111 | Control |
| 7 | M139 | Control |

TABLE 31

Strains expressing AE9 selected for screening on corn flour in shake flasks (FIG. 77, bottom).

| # | Strain ID | Strain description |
|---|-----------|--------------------|
| 1 | P2-9 | M139 + AE9 |
| 2 | P11-20 | M139 + AE9 |
| 3 | P12-84 | M139 + AE9 |
| 4 | P12-65 | M139 + AE9 |
| 5 | P12-17 | M139 + AE9 |
| 6 | M2111 | Control |
| 7 | M139 | Control |

TABLE 32

The best strains from shake flask screening experiments on homemade mash and corn flour (FIGS. 75-77) selected for screening on industrial corn mash in shake flasks (FIG. 78).

| # | Strain ID | Strain description | MXXXX |
|---|-----------|--------------------|-------|
| 1 | T2-6 | M2111 + AE9 | M2327 |
| 2 | T4-1 | M2111 + AE7 | M2328 |
| 3 | T4-8 | M2111 + AE7 | M2329 |
| 4 | P11-67 | M139 + AE9 (1000 colonies screen) | M2330 |
| 5 | P12-65 | M139 + AE9 (1000 colonies screen) | M2331 |
| 6 | P12-84 | M139 + AE9 (1000 colonies screen) | M2332 |
| 7 | T2-25 | M2111 + AE3 + AE5 + AE7 (D.o. genes) | M2333 |
| 8 | T2-40 | M2111 + AE3 + AE5 + AE7 (D.o. genes) | M2334 |
| 9 | T2-64 | M2111 + AE3 + AE5 + AE7 (D.o. genes) | M2335 |
| 10 | T3-32 | M2111 + AE3 + AE5 + AE7 (D.o. genes) | M2336 |
| 11 | M2111 | Control | |
| 12 | ER | Control | |
| 13 | M139 | Control | |

TABLE 33

The best strains from shake flask screening experiments on homemade mash and corn flour (FIGS. 75-77) selected for screening on industrial corn mash in shake flasks (FIG. 79).

| # | Strain ID | Strain description | MXXXX |
|---|-----------|--------------------|-------|
| 1 | T5-88 | M2111 + AE1 | M2337 |
| 2 | T18-11 | M2111 + SE35 | M2338 |
| 3 | b | M2111 + AE1 + AE8 + AE10 (S.f. genes) | M2339 |
| 4 | d | M2111 + AE1 + AE8 + AE10 (S.f. genes) | M2340 |
| 5 | p | M2111 + AE1 + AE8 + AE10 (S.f. genes) | M2341 |
| 6 | T6-88 | M2111 + SE32 + ABF | M2342 |
| 7 | T11-12 | M2111 + SE34 + AXE | M2343 |
| 8 | T11-45 | M2111 + SE34 + AXE | M2344 |
| 9 | T12-81 | M2111 + SE34 + FAE1 | M2345 |
| 10 | M2111 | Control | |
| 11 | ER | Control | |
| 12 | M139 | Control | |

TABLE 34

Strains selected as best performers on industrial corn mash (FIGS. 78 and 79).

| Strain ID | Strain description |
|-----------|--------------------|
| T11-45 | M2125 + SE34 + SE66 |
| T2-40 | M2125 + AE3 + AE5 + AE7 |
| T4-8 | M2125 + AE7 |
| P12-84 | M139 + AE9 |

Example 33

Stability of Strains Built by Directed and Random Integration

Stability of the M2111 strain built by directed integration was tested. M2111 demonstrated remarkable stability. There was no decrease in activity up to 99 generations in non-selective YPD media (FIG. 80, top). In order to test if random integration strains have sufficient stability for use in industrial fermentation, two of the best performing strains from homemade mash and corn flour shake flask fermentation experiment, T4-1 (M2125+AE7) and T2-6 (M2125+AE9) (FIGS. 75 and 76) were subjected to the same stability test as M2111 (FIG. 80, bottom). FIG. 80 shows that even though these tested random strains do not have the same level of stability as directed M2111, they lost very little activity throughout propagation on YPD. There is no loss in activity for up to 9-10 generations. Only 10% is lost at about 50 generations, and 20% at about 99 generations. The pattern of activity decrease was very similar for two different random strains. During industrial yeast preparation cells go through about 28 generations (volume increased 300000000 times). In propagation stage cells go though about 4 generations and 4 generations during fermentation. Thus, the total number of generations is about 36. Therefore, no significant activity will be lost during all stages of industrial application, considering that only 10% is lost at about 50 generations.

Example 34

Integration Strategies for Directed Strains Construction Expressing Multiple Enzymes FIG. 81 demonstrates one site integration strategy (top) and multiple sites strategy (middle) that could be used to construct strains expressing multiple enzymes. In one site strategy, negative markers alternate in each transformation round and all expression cassettes integrated into the same locus next to each other. In multiple sites strategy, positive and negative markers alternate with each other and in each round of transformation the expression cassette can be integrated into any site on chromosome.

Example 35

Expression of Several Cellulolytic Enzymes in a Single Yeast Strain for Hydrolysis of Wood From the data generated by mixing several cellulases in assays in either crude or purified form, it was determined that a strain producing multiple cellulolytic activities would increase the ability of the expressing strain to hydrolyze lignocellulose. To test this idea, strains of S. cerevisiae that expressed up to 7 enzymes simultaneously were created. Briefly, a robust, xylose utilizing strain, M1577, was first engineered to make high levels of the C. lucknowense CBH2.

Two transformations were carried out in series to generate this strain. In the first step, plasmid pMU2115 was digested with NotI to create an integration cassette that targets a CBH2 expression and zeocin selection cassette to the rDNA loci. Colonies from this transformation were selected for on yeast extract (10 g/L), peptone (20 g/L), and xylose (20 g/L) containing agar with zeocin (YPX+zeo), picked, and screened for enzyme activity in an avicel assay protocol. Once the best transformant from those screened was identified, this transformant was transformed again with 2 additional constructs for CBH2 expression. One of these, pMU2143 (digested with NotI) targets a CBH2 expression construct and the kanamycin resistance marker to repeated tau1 genomic loci in *S. cerevisiae*. The other plasmid, pMU2142 (also digested with NotI) targets a CBH2 expression construct and the hygromycin resistance marker to repeated tyB genomic loci. Following this second transformation and selection on YPX agar plates with zeocin, hygromycin, and G418 present, colonies were again screened using the avicel assay method described below. The strain with the highest CBH2 production was stored and named M1873. M1873 is capable of producing ~150 mg/L of CBH2 in shake flask fermentations as measured by a HPLC assay.

M1873 was subsequently transformed with PCR cassettes that were assembled by yeast via homologous recombination to create a cassette that allows for co-expression of four cellulases (endoglucanases) at the *S. cerevisiae* FCY1 locus. These four endoglucanses were EG1 from *Aspergillus fumigatus*, EG2 from *Trichoderma reesei*, EG3 from *Neosartorya fischeri*, and Cel9A from *Thermobifida fusca*, all under control of different promoters and terminators from *S. cerevisiae* (ENO1 promoter/PYK1 terminator, PMA1 promoter/ENO1 terminator, TPI1 promoter/FBA1 terminator, and PDC1 promoter/ENO2 terminator). Table 35 lists the primers and templates used to generate the proper fragments for assembly. Table 37 lists all the primer sequences and the plasmid sequences are listed below as well. After transformation, strains were selected for resistant to 5-fluorocytosine, which is toxic to cells that have an intact FCY1 locus. In addition, strains were checked for their resistance to Clonat, and checked by PCR (X10821/X10824) for an in tact FCY1 locus. Strains showing Clonat resistance and no native FCY1 locus were screened for activity using the CMC activity assay, and the PHW assay. The strain producing the most glucose from PHW was stored and called M2217. The retention of CBH2 production was confirmed by the HPLC assay.

After M2217 was built, a final transformation was used to generate strains that also expressed the *Talaromyces emersonii* CBH1 fused with the CBD from *Humicola grisea* (pMU1392). This was carried out in the same way as described above, only with a different set of PCR products. In addition, two pieces for the gene assembly were derived from a digestion of a plasmid, rather than as a PCR product. Table 36 lists the fragments used. Two copies of an expression cassette for a gene encoding a fusion protein between the *T. emersonii* CBH1 and the *Humicola grisea* CBD (from the *H. grisea* CBH1) were placed facing each other with integration flanks specific to the δ sites of the Ty1 transposon (FIG. 82). Following transformation cells were plated to media containing 6.7 g/L Yeast Nitrogen Base and 20 g/L Cellobiose as the sugar source. This media allows for selection of transformants based on selection for expression and secretion of the *S. fibuligera* BGLI. Transformants were then screened for activity in the PHW assay and the top candidates were stored and given the numbers M2230, M2231, and M2232.

After this set of strains had been built a final comparison was carried out using the PHW assay. Briefly, the set of strains was grown up aerobically in YPD media for 2 days in 48 well plates. The supernatants from these cultures were added to PHW (4% total solids final concentration), along with a small amount (2 mg/g) of cellulase enzyme from *Trichoderma reesei* supplied by AB Enzymes and buffer. The amount of glucose released from the PHW was followed over time by HPLC. The data from this comparison can be found in FIG. 83. M1873, producing only the *C. lucknowense* CBH2 provides a large increase in activity relative to the control strain M1577 in this test—an approximate 176% increase in glucose release. The addition of set of four endoglucanases, provides another increase relative to M1873 of 18%, and the addition of CBH1 and BGL provide another 28% increase above that. Overall, strains producing 7 cellulolytic enzymes increase hydrolysis over the negative control strain by >3 fold over the control strain, and by >50% relative to a strain producing only a single enzyme.

A set of strains from those described above was subsequently tested for its ability to impact the amount of ethanol produced from pretreated hardwood. FIG. 84 presents data from simultaneous saccharification and fermentation (SSF) reactions containing a small amount of externally added cellulase enzyme. SSF conditions were as follows: final solids loading was 18% (w/w) of substrate MS887 (an insoluble substrate derived from pretreating hardwood with water), 2 mg AB Enzyme cellulase preparation/g total solids, 10% v/v inoculum, 35° C., pH 5.5 controlled with 5 g/L $CaCO_3$. The medium used was Corn Steep Liquor (CSL, 12 g/L) and diammonium phosphate (DAP, 0.5 g/L). Reactions were carried out in sealed plastic centrifuge bottles, fitted with vents and mixed via large stir bars, by combining all the above ingredients in a 100 gram final mass batch culture, mixing at 225 rpm on a shaker, and sampling over 160 hours. M1873 and M2232 both were able to produce more ethanol under these conditions than non-cellulolytic M1577. M1873 could increase yield by 15% and 33% relative to M1577 on unwashed and alkaline washed pretreated hardwood respectively. M2232 could produce 20% and 43% more ethanol than M1577 on these two substrates. The ability of M2232 to produce more ethanol that M1873 demonstrates the utility of expressing the package of 7 enzymes simultaneously in a single strain.

TABLE 35

PCR fragments used to assemble EG expression islands in *S. cerevisiae*.

| Piece ID No. | Description | Primers | Template |
|---|---|---|---|
| 1 | FCY f1 | X11631/X12837 | gDNA |
| 2 | EG1 | X12838/X12822 | pMU1821 |
| 3 | EG2 | X12823/X12824 | pMU1479 |
| 4 | EG3 | X12825/X12826 | pMU1958 |
| 5 | Cel9A | X12827/X12828 | pMU1975 |
| 6 | Clonat Marker | X12829/X12841 | pMU227 |
| 7 | FCY f2 | X12842/X11634 | gDNA |

TABLE 36

PCR fragments used to assemble CBH1 expression islands in *S. cerevisiae*.

| Piece ID No. | Description | Primers | Template |
|---|---|---|---|
| 1 | Delta f1 | X12427/X13008 | gDNA |
| 2 | Eno1p-TeCBH1 + HgCBD | NA | Digest of pMU1392 with SmaI and AscI |
| 3 | CYC term 1 | X13009/X13010 | pMU2142 |
| 4 | AgTef term | X13011/X13012 | pMU183 |
| 5 | SfBGL | NA | pMU1260 digest with PacI/AscI |
| 6 | AgTef prom | X13013/X13014 | pMU183 |
| 7 | CYC term 2 | X13009/X13015 | pMU2142 |
| 8 | Delta f2 | X13016/X12434 | gDNA |

TABLE 37

Primers used in the construction of these strains

| Primer Name | Sequence (5'-3') | Description | SEQ ID NO |
|---|---|---|---|
| X10821 | AAGAGGGTGGTGTTCCTATTGGCGGATGTCTTATCAATAACAAAGACGGAAGTGTTCTC | FCY check for | 526 |
| X10824 | TTTTGAAATTAACGTTCTCACCGACAACACAGCGTGGAATACCATACATGATGATGGCA | FCY check rev | 527 |
| X11631 | TTGCCAAAGTGGATTCTCCTACTCAAGCTTTGCAAACAT | FCY f1 for | 528 |
| X12837 | GAAGCTCGGATCAGTAGATAACCCGCCTAGAAGACTAGTAGCTATGAAATTTTTAACTC | FCY f1 rev | 529 |
| X12838 | GAGAGCCAGCTTAAAGAGTTAAAAATTTCATAGCTACTAGTCTTCTAGGCGGGTTATC | EG1 for | 530 |
| X12822 | GTTTTTTCCCCGTCAGCGATGGTGACGTAAACGACTAGATTTAGGACACTAATTGAATC | EG1 rev | 531 |
| X12823 | AAAAAATGACGCGGGCAGATTCAATTAGTGTCCTAAATCTAGTCGTTTACGTCACCATC | EG2 for | 532 |
| X12824 | GATGGGTTCCTAGATATAATCTCGAAGGGAATAAGTAGGCAAAGAGGTTTAGACATTG | EG2 rev | 533 |
| X12825 | GTTCTAAGCTCAATGAAGAGCCAATGTCTAAACCTCTTTGCCTACTTATTCCCTTCGAG | EG3 for | 534 |
| X12826 | GTTTATTACATGAAGAAGAAGTTAGTTTCTGCCTTGCTTGCTAGAGAATAAATTCAAG | EG3 rev | 535 |
| X12827 | GTTCAACATCATCTTTTAACTTGAATTTATTCTCTAGCAAGCAAGGCAGAAACTAAC | Cel9A for | 536 |
| X12828 | CGGGTGACCCGGCGGGACGAGGCAAGCTAAACAGATCTCAAACAACTTAAAATCAGTC | Cel9A rev | 537 |
| X12829 | GGCATATCAAGACCCTGCCTGGACTGATTTTAAGTTGTTTGAGATCTGTTTAGCTTGCC | Clonat for | 538 |
| X12841 | ATATAAAATTAAATACGTAAATACAGCGTGCTGCGTGCTATTAAGGGTTCTCGAGAGC | Clonat rev | 539 |
| X12842 | CCAGTGTCGAAAACGAGCTCTCGAGAACCCTTAATAGCACGCAGCACGCTGTATTTACG | FCY f2 for | 540 |
| X11634 | TAGCCCTTGGTTGAGCTTGAGCGACGTTGAGGT | FCY f2 rev | 541 |
| X12427 | GGCCGCTGTTGGAATAAAAATCC | Delta f1 for | 542 |
| X13008 | CTCGGATCAGTAGATAACCCGCCTAGAAGACTAGTGGATCGATCCCCGGGATGTTTATATTCATTGATCCTATTACATTATCAATCC | Delta f1 rev | 543 |
| X13009 | ATCTGTACCAAGTTGAACGACTGGTACTCTCAATGTTTATAAGGCGCGCCACAGGCCCCTTTTCCTTTG | CYC term 1 for | 544 |
| X13010 | CCGCCATCCAGTGTCGAAAACGAGCTCGTCGACAACTAAACTGGAATGTG | CYC term 1 rev | 545 |
| X13011 | CCTCACATTCCAGTTTAGTTGTCGACGAGC TCGTTTCGACACTGGATGG | AgTef term for | 546 |
| X13012 | GCTGTTAATGATATCAAGACATCTGTCCTGTTTACTATTTGAGGCGCGCCTCAGTACTGACAATAAAAAGATTCTTG | AgTef term rev | 547 |
| X13013 | GCGACGCCGGCGAGGAGGGAGGTGAAGGAGACATTTGTTTTTAATTAAGGTTGTTTATGTTCGGATGTGATG | AgTef prom for | 548 |
| X13014 | TTGTTGTTCCCTCACATTCCAGTTTAGTTGTCGACAGCTTGCCTTGTCCC | AgTef prom rev | 549 |
| X13015 | GGTGACCCGGCGGGACAAGGCAAGCTGTCGACAACTAAACTGGAATGTG | CYC term 2 rev | 550 |
| X13016 | GCTCAATTAGTGGACGTTATCAGG | Delta f2 for | 551 |
| X12434 | CCGCGGTGAGATATATGTGGGTA | Delta f2 rev | 552 |

Example 36

Expression of Accessory Enzymes in Yeast

For the proteins described below, various enzymes were expressed in yeast in their native form as well as with the addition of a cleavable His tag for the purposes of increased ease of purification. Proteins were assayed with and without the His tag to determine if the tag influenced the activity or banding pattern of the protein. If deemed necessary, tags can be removed in subsequent enzyme evaluation assays after cleavage with enterokinase and re-purification. Genes were PCR amplified or codon optimized and synthesized and cloned into vector pMU1531 that had been digested with Pac1 and Asc1. A C-terminal enterokinase site expressed as amino acids DDDDK, linker expressed as amino acids GGSPPS and 6xHis tag expressed as amino acids HHHHHH were added by yeast via homologous recombination, and constructs were sequenced to confirm the tag sequence was intact and the gene and tag were in-frame.

Colonies from transformations were grown in indicated media for 48-72 hours. Cultures supernatants were filtered through a 2 um PE filter and concentrated approximately 20-fold using 10,000 molecular weight cut off filters. Protein quality was screened via SDS-PAGE electrophoresis under non-reducing conditions.

Expression of Alpha-Glucuronidase in Yeast

*Pichia stipitis* alpha-glucuronidase, GH67 (NCBI#ABN67901) was expressed in yeast (FIG. 85). Alpha-glucuronidase is predicted to be approximately 111 kDa (untagged) and 113 (C-terminal His tagged), and is seen as a band between 100 and 150 kDa in FIG. 85. Most GH67 alpha-glucuronidases characterized to date liberate MeGlcA residues linked to terminal xylopyranosyl residues. The protein described here liberates McGlcA residues linked to terminal and internal xylopyranosyl residues (Ryabova et al, *FEBS Letters* 583:1457-1462, (2009)).

Expression of Xyloglucanases in Yeast

Several xyloglucanases (Table 38) were functionally expressed in *S. cerevisiae* (FIGS. 86-87). The strain expressing *Aspergillus niger* XGL produced the most activity; however. His tag addition had a negative effect on activity (about 50% less activity at 1 hour).

Secreted xyloglucanases were also characterized by Silver stained SDS-PAGE and Westen blot analysis (FIG. 88). On SDS-PAGE a large clear band was visible for *Aspergillus niger* xgl1 (~150 kDa); no band for *Aspergillus aculeatus* xgl1; and a discrete band for *Neosartorya fischeri* xgl (~130 kDa). His tag versions of the proteins showed apparently less secreted protein. The Western blot analysis showed that the signals for the *Aspergillus niger* xglHis tag was strong; for *Neosartorya fischeri* xglHis tag was poor, and A.c.xgl-His tag was not visible. *Trichoderma reesei* xgl+/−His tag was not examined due to undetectable activity in the AZCL xyloglucan assay.

Expression of α-Galactosidases in Yeast

Several alpha-galactosidases (Table 40) were functionally expressed in yeast (FIGS. 91-93). All AGL1 and 2 expressing strains exhibited secreted activity (FIG. 91), but the His tag had a negative impact on activity (decreased by about 50%). AGL3 strains were not available for testing at the time these experiments were conducted.

Alpha-galactosidases were also analyzed by Western blot (FIG. 92) and silver stain (FIG. 93). *Trichoderma reesei* AGL3 sample had one prominent band at approximately 50-70 kDa by Western blot. On SDS-PAGE visible (smeared) bands (over 100 kDa) are noted for *Trichoderma reesei* agl1 and *Talaromyces emersonii* agl1 (predicted sizes: 48.5 & 49.4 kDa); discreet band of ~80 kDA noted for *Trichoderma reesei* agl2 (predicted size: 82 kDa), but was poorly expressed (not shown).

TABLE 38

Xyloglucanases expressed in *Saccharomyces cerevisiae*

| Activity: | Enzyme: | Organism: | Accession number | Plasmid | Untagged size | Tagged size |
|---|---|---|---|---|---|---|
| xyloglucanase | GH74A (EGL6) | *Trichoderma reesei* | AAP57752 | pMU2088 | 87.0 kDa | 88.9 kDa |
| | GH74A (EGL6) | *Aspergillus niger* | AAK77227 | pMU2856 | 90.3 kDa | 92.2 kDa |
| | GH74A (EGL6) | *Aspergillus aculeatus* | BAA29031 | pMU2857 | 89.7 kDa | 91.6 kDa |
| | GH74A (EGL6) | *Neosartorya fischeri* XG* | XP_001261776 | pMU2858 | 89.3 kDa | 91.2 kDa |

Expression of Esterases in Yeast

Several esterases (Table 39) were functionally expressed in *S. cerevisiae*. The expression was characterized by SDS-PAGE (FIG. 89) and activity assay (FIG. 90). SDS-PAGE analysis demonstrated that *Aspergillus niger* FAEA (pMU1880) showed a prominent band at ~36 kDa. *Chaetomium globosum* FAEB (pMU1882) showed multiple visible bands, and no bands were noted for *Aspergillus terreus* FAEA (pMU1884). Prominent bands were visible for *Chaetomium globosum* CIP2 (pMU2095+/−C His tag) and *Trichoderma reesei* CIP2 (pMU2097) glucuronyl esterases. 1-Napthyl-acetate was used to assay ferulic acid esterases (FIG. 90), but this substrate did not work well for the glucuronoyl esterases. Glucuronoyl esterases were not tested further for activity. *Aspergillus niger* FAEA (pMU1880) exhibited the best activity on this substrate followed by *Chaetomium globosum* FAEB (pMU1882).

TABLE 39

Esterases expressed in *Saccharomyces cerevisiae*

| Activity: | Enzyme: | Organism: | Accession number | Plasmid | Untagged size | Tagged size |
|---|---|---|---|---|---|---|
| ferulic acid/cinnamoyl esterase | CE1 (FAEA) | *Aspergillus niger* | XP_001393337 | pMU1880 | 30.5 kDa | 32.4 kDa |
| | CE1 (FAEA) | *Aspergillus terreus* | XP_001211092 | pMU1884 | 35.5 kDa | 37.4 kDa |
| | CE1 (FAEB) | *Talaromyces stipitatus* | EED17739 | pMU1881 | 37.5 kDa | 39.4 kDa |
| | CE1 (FAEB) | *Chaetomium globosum* | XP_001228412 | pMU1882 | 36.7 kDa | 38.6 kDa |
| glucuronyl esterase | CIP2 | *Trichoderma reesei* | AAP57749 | pMU2097 | 48.2 kDa | 50.1 kDa |
| | CIP2 | *Chaetomium globosum* | XP_001226041 | pMU2095 | 49.8 kDa | 51.7 kDa |

TABLE 40

Alpha-galactosidases expressed in *Saccharomyces cerevisiae*

| Activity: | Enzyme: | Organism: | Accession number | Plasmid | Untagged size | Tagged size |
|---|---|---|---|---|---|---|
| alpha-galactosidase | GH27 (AGL I) | *Trichoderma reesei* | CAA93244 | pMU2859 | 48.4 kDa | 50.3 kDa |
| | GH27 (AGL I) | *Talaromyces emersonii* | EU106878 | pMU2860 | 49.3 kDa | 51.2 kDa |
| | GH27 (AGL II) | *Trichoderma reesei* | Z69254 | pMU2861 | 82.0 kDa | 83.9 kDa |
| | GH27 (AGL III) | *Trichoderma reesei* | CAA93246 | pMU2697 | 67.0 kDa | 68.9 kDa |

Example 37

Enzymatic Conversion of Pretreated Mixed Hardwoods

To assess the effect of various enzymes on pretreated mixed hardwoods (PHW), an assay was conducted with 2% solids, pH 5.0 and 38° C. Yeast-produced and purified enzymes were assessed in the assay either with or without additional commercial enzymes. The activity of the mix with yeast-produced enzymes evaluated by the release of sugars, predominantly glucose due to the nature of the pretreatment, by HPLC using a BioRad 87H column. The data below shows the results of some of those mixing experiments. FIG. 94 shows that the addition of CBH2, BGL, EG1, EG2 and EG3 improves hydrolysis of the substrate above what the commercial enzyme mix can do with just the addition of CBH2 and BGL. Therefore, yeast-made EG1, EG2 and EG3 provide benefits in hydrolyzing PHW. FIG. 95 shows that further addition of yeast-produced and purified xylanase, xylosidase and AXE improved hydrolysis of the PHW above what was seen with either just the commercial enzyme mix or the commercial mix with CBH2 added. This further suggests the benefits of the accessory enzymes described above.

FIG. 96 shows that the addition of these enzymes in combination continues to show improvement over the addition of just one of the accessory enzymes.

Example 38

Enzymatic Conversion of Paper Sludge

The information above was done on PHW in the presence of commercial enzymes. The following data shows the effectiveness of the purified, yeast-produced enzymes to hydrolyze paper sludge without any additional enzymes added in both a 2%, pH 5.0, 38° C. hydrolysis assay as well as an SSF. These results are compared to the same assay or fermentation with the addition of commercial enzymes.

These data in FIGS. 97 and 98 show that the combination of CBH1, CBH2, BGL, EG1, EG2. EG4, EG5, xylanase and xylosidase hydrolyze more substrate when combined together than when assayed alone. This was further confirmed in fermentation (FIG. 99). The purified enzymes were analyzed by SSF on two different types of industrial paper sludge. Both paper sludge substrates were washed with 1M citric acid. The SSFs were carried out under the following conditions: 2% total solids, 1.1 g/L dry cell weight M2108, 15 mg/mL Tetracycline, YP media, pH 5.0, 35° C. and 220 rpm. A selected cocktail of yeast made enzymes was dosed at 4.1 mg/g TS and compared to a dose response of AB Whole Broth ranging from 0-6.1 mg/g TS. The purified enzyme cocktail is specified in Table 41 and the results are shown in FIG. 99. Based on data shown on FIG. 99, the yeast made enzyme dose is equivalent to a dose of approximately 3 mg/g TS AB Whole Broth commercial enzymes mix on both substrates. These data support the claim that the combination of the yeast-produced, purified enzymes can hydrolyze industrially relevant substrates such as paper sludge without any additional commercial enzymes. Generated by yeast made enzymes sugars are successfully converted by yeast to ethanol in SSF process.

TABLE 41

Yeast made enzyme cocktail used in paper sludge SSF.

| Enzyme | dose (mg/g TS) |
|---|---|
| TeCBH1 with Hg CBD | 2.25 |
| Cl CBH2 | 0.7 |
| Sf BGL | 0.1 |
| Af EG1 | 0.35 |
| Hj EG2 | 0.15 |
| Tt EG4 | 0.05 |
| Cl EG5 | 0.05 |
| EG6 | 0.05 |
| An Xyn | 0.2 |
| Ptr Xld | 0.2 |
| Total | 4.1 |

TABLE 42

Summary of the best yeast expressed cellulases, hemicellulases and accessory enzymes. Highlighted yellow—key enzymes for wood conversion; Yellow + Green—key enzymes for paper sludge conversion (based on data shown in FIGS. 94-99).

| Type of Activity | Cazy family/ enzyme type | Well-Expressed Candidates | Accession Number |
|---|---|---|---|
| exoglucanase | GH7A (CBH1) | *T. emersonii* CBH1 + HgCBD | See underlined orf in pMU1392 |
| | GH6A (CBH2) | *C. lucknowense* CBH2 | See patent application WO/2010/060056 |

TABLE 42-continued

Summary of the best yeast expressed cellulases, hemicellulases and accessory enzymes. Highlighted yellow—key enzymes for wood conversion; Yellow + Green—key enzymes for paper sludge conversion (based on data shown in FIGS. 94-99).

| Type of Activity | Cazy family/ enzyme type | Well-Expressed Candidates | Accession Number |
|---|---|---|---|
| endoglucanase | GH7B (EG1) | A. fumigatus EG1 | XP_747897 |
| | GH5A (EG2) | T. reesei EG2 | See patent application WO/2010/060056 |
| | GH12A (EG3) | N. fischeri EG3 | XP_001261563 |
| | GH61A (EG4) | T. terrestris EG4 | ACE10231 |
| | GH45A (EG5) | C. lucknowense EG5 | ACH15008 |
| | GH6 (EG6) | N. crassa EG6 | XP_957415 |
| | GH5 (bact.) | C. cellulolyticum Cel5A | YP_002505438.1 |
| | GH? (bact.) | B. subtilis EGLS | CAB 13696.2 |
| | GH9 (bact.) | T. fusca Cel9A | YP_290232 |
| | GH8 (bact.) | C. cellulolyticum Cel8c | AAA73867.1 |
| xyloglucanase | GH74A (EGL6) | A. niger XG | AAK77227 |
| β-glucosidase | BGLI | S. fibuligera BGLI | See patent application WO/2010/060056 |
| xylanase | GH11 (XYN2) | T. reesei xyn2 | ABK59833 |
| | GH10 | A. niger xyn10 | CAA03655.1 |
| β-xylosidase | GH3 | A. niger Xld3 | XP_001389416 |
| | GH43 (BXL1) | Pyrenophora tritici-repentis BXL | XP_001940956 |
| beta-mannase | GH5 (MAN1) | A. aculeatus MAN5 | AAA67426 |
| beta-mannosidase | GH26 | C. phytofermentens mannosidase | YP_001559376,1 |
| acetylxylanes-terase | CE1 (AXE) | N. fischerii AXE1 | XP_001262186 |
| arabinofura-nosidase | GH54 (ABF1) | A. niger ABFB | AAA93264 |
| ferulic acid/cinna-moyl esterase | CE1 (FAEA) CE1 (FAEB) | A. niger FAEA T. stipitatus FAEB | XP_001393337 EED17739 |
| A-glucuronidase | GH67 | Pichia stipitis | ABN67901 |

Example 39

Strain Identification and Activities for Strains Tested on 30% TS Corn Flour Supernatants were assayed on the supernatant remaining at the end of a corn mash fermentation to determine if any of these enzymes could further hydrolyze the soluble oligomers. Cell supernatants of strains engineered with α-glucosidase activity released glucose from soluble oligomers remaining at the end of a corn mash fermentation. The increase observed was higher than cell supernatant from the background strain (M749). All samples contained a blanket dose of commercial glucoamylase.

The control M0139 with 0.3 AGU/g TS GA reaches 121 g/L ethanol with potential ethanol of 127 g/L. M2111 is a bit higher with respect to both ethanol produced and potential ethanol, showing a CBP effect. There are a handful of strains that have potential ethanol of over 128 g/L, with T2-6 at 133 g/L. T2-6 (AE9) reached the highest ethanol titers as well, 125 g/L. T11-32 (BC60, AXE) also has potential ethanol over 130 g/L. All of these strains show a CBP effect over the control strain.

TABLE 43

Groups of enzymes used in evaluation of pretreated wet cake with the addition of supernatants

| Protein | | Group Name |
|---|---|---|
| CBH1 | Big 4 | Big 6 |
| CBH2 | | |
| EG2 | | |
| BGL | | |
| Xyl | Big 2 | |
| Xld | | |

M0139 is the control strain and has no enzymatic activities. Each yeast-made purified enzyme was added to the control strain and a small benefit is seen. When added together, as seen with the Big 4 or Big 6, a large increase in hydrolysis is seen. The largest glucose and xylose yields are seen with the addition of 1 mg/g TS commercial Pectinase (Multifect) to the Big 6.

Example 40

Strain Identification and Activities Expressed in Supernatant that were Evaluated on Pretreated Wet Cake (ELN Afoster2 Corn-074

Corn wet cake that was pretreated by autohydrolysis in the steam gun (30% TS, 160° C., 20 minutes) was used to evaluate the effect on hydrolysis when yeast-made purified enzymes are used in the presence of a mixture of commercial enzymes. The mixture of commercial enzymes (referred to as MM) used was 0.9 mg/g TS AB Whole Broth, 0.1 mg/g TS Multifect Pectinase and 0.1 mg/g TS Spirizyme GA. Purified CBH1 was added at a concentration of 1 mg/g TS where all other purified enzymes were added at 0.25 mg/g TS. These enzymes were added to 2% TS pretreated wet cake (PWC), 75 mM Na citrate buffer pH 5.0, 0.01% Na Azide to a total volume of 4 mLs in a 24 well plate. The hydrolysis was incubated at 35° C., 220 rpm. The 48 hour results are shown in FIG. 102.

The glucose released with just the commercial enzyme mix "MM" is 2.8 g/L. When purified yeast made enzymes are then loaded in addition to "MM," an increasing trend in hydrolysis is observed. When all of the purified enzymes are added without "MM," (shown in the last bar on the right side of the graph), glucose release is still observed. The addition of purified enzymes with or without commercial enzymes shows hydrolysis. Corn coarse fiber (similar to wet cake but with the protein removed) was pretreated in the steam gun at 190° C. for 10 minutes with water where another condition used 1% sulfuric acid for the pretreatment. These two substrates were evaluated in the presence of a commercial enzyme mixture with the addition of purified yeast made enzymes, similar to the previous experiment. The purpose of this particular assay was to determine the best ratio of purified CBH1 and CBH2 in the presence of 1 mg/g TS commercial enzyme mixture of C-tee:H-tec:Multifect Pectinase at ratios of 30%:45%:25% with 0.5 U/gTS Depol FAE. The various mixtures used are specified in Table 44 and the results are shown in FIG. 103.

TABLE 44

Mixtures of purified enzymes used to determine the optimal ratio of CBH1 to CBH2 on pretreated corn coarse fiber. The commercial mixture of C-tec:H-tec:Multifect Pectinase at ratios of 30%:45%:25% with 0.5 U/gTS Depol FAE was dosed at 1 mg/g TS to each sample

| | | mg/gTS | | | | | | | | |
|---|---|---|---|---|---|---|---|---|---|---|
| | mg/mL | Mix 1 | Mix 2 | Mix 3 | Mix 4 | Mix 5 | Mix 6 | Mix 7 | Mix 8 | Mix 9 |
| CBH1 | 2.45 | 3 | 2.25 | 1.5 | 0.75 | 0 | 4 | 2.25 | 2.25 | 2.25 |
| CBH2 | 1.24 | 0 | 0.75 | 1.5 | 2.25 | 3 | 0 | 0.75 | 0.75 | 0.75 |
| BGL | 0.83 | 0.1 | 0.1 | 0.1 | 0.1 | 0.1 | 0.1 | 0.1 | 0.1 | 0.1 |
| XYN(SE34) | 1.48 | | | | | | | 0 | 0.5 | 0.33 |
| XLD | 3.34 | | | | | | | 0 | 0.5 | 0.33 |
| AXE | 1.18 | | | | | | | 1 | 0 | 0.33 |
| comm enzyme mix | 5 | 1 | 1 | 1 | 1 | 1 | 1 | 1 | 1 | 1 |
| total yeast-made dose | | 3.1 | 3.1 | 3.1 | 3.1 | 3.1 | 4.1 | 4.1 | 4.1 | 4.1 |

Results showed that decreasing amounts of CBH1 correlate to a decrease in glucose yields. This effect was more dramatic on the acid pretreated coarse fiber than on the 190° C., 10 min substrate. When 4 mg/g TS CBH1 only is added, there is an equal or better yield seen than when there is CBH2 present. In short, the more CBH1, the better the glucose yields. Additions of XLD. XLN and AXE (0.33 mg/g TS each) also helped boost final yields a small amount over the commercial enzyme mixture.

Example 41

Methods

Yeast Strains

M0509 (NCPy102; ura-3::kanMX/ura-3::kanXMX gre3::loxP/gre3::loxP TAL1+/loxP-PTPI-TAL1 RKI1+/loxP-PTPI-RKI1 RPE1+/loxP-PTPI-RPE1 TKL+/loxP-PTPI-TKL delta::PTPI-xylA PTPI-XKS) and M0749 (NCPy102; ura-3::kanMX/ura-3::kanMX gre3::loxP/gre3::loxP TAL1+/loxP-PTPI-TAL1 RKI1+/loxP-PTPI-RKI1 RPE1+/loxP-PTPI-RPE1 TKL+/loxP-PTPI-TKL delta::PTPI-xylA PTPI-XKS fur1Δ::Nat/FUR1) strains derived from diploid wine strain NCP Y120 (obtained from University of Stellenbosch, South Africa) and are described in McBride et al., WO 2010/060056, 2010. M0139 (MAT a/MAT alpha) is $S.\ cerevisiae$ diploid wine strain that was received from University of Stellenbosch. M1744 is derivative of M0139 with double URA3 knockout (markerless). Ethanol Red (ER) is commercially available diploid ethanologen strain that was obtained from Lesaffre Corp.

Starch-DNS Assay

Reagents:

Dinitrosalicylic Acid Reagent Solution (DNS), 1%
(Could be stored at 4° C. for several months)
 3,5-dinitrosalicylic acid: 10 g
 Sodium sulfite: 0.5 g
 Sodium hydroxide: 10 g
 Add water to: 1 liter
 Calibrate DNS by glucose (use glucose samples with conc. 0,1,2,3,4,5 and 6 g/l, calculate the slope [S])
 Starch 2.2%, pH 5.0
(Prepare fresh before use: will be diluted by enzymes to 2%)
 Dissolve 1.1 g of corn starch in 50 ml of water in a boiling water bath
 Add 1 ml of 3M NaAc buffer pH 5.0

Procedure:
1. Aliquot starch into 96w PCR plate 150 µl/well (one well for each sample to be measured). Shake starch between refilling repeat pipette to prevent starch settling.
2. Aliquot DNS into different 96w PCR plate 50 µl/well (two wells for each sample to be measured)
3. Add 16.7 µl of enzyme sample (cells supernatant) into starch, mix and immediately take 25 µl into 50 µl of DNS (control sample at t=0)
4. Incubate enzyme/starch samples at 35° C. for 3 h in PCR machine
5. Take 25 µl of enzyme/starch samples into 50 µl of DNS (t=3 h samples)
6. Incubate DNS samples at 99° C. for 5 min to develop a color and cool down at 4° C. for 5 min (use PCR machine)
7. Transfer 50 µl of DNS sample into 96 w assay plate and measure absorbance at 565 nm Amylolytic activity [A] calculation (% of starch converted):

$$A(\%) = \frac{OD_{565}[t=3h] - OD_{565}[t=0] \ g/L \times 100\%}{S(DNS \ \text{slope}) \ 20 \ g/L}$$

Should use supernatant of cell cultures with the same growth OD. If cells are grown differently, the activity should be normalized by cells density.

Starch-GHK Assay

Reagents:

Hexokinase (HK) reagent
(Could be stored at −20° C. for several months)
 Add 50 ml of water into HK reagent bottles (Sigma #G3293-50 mL) and mix by turning up and down (usually use 6 bottles to make stock)
 After complete dissolving combine reagent from all bottles and add Tris (5.45 g per 6 bottles)
 Prepare 22 mL aliquots in 50 mL screw cap centrifuge tubes. (One tube is sufficient to assay a 96 well microplate).
 Store aliquots frozen
 Calibrate each new stock by glucose standards and calculate the slope S (with glucose conc. 2, 1, 0.5, 0.25, 0.125, 0 g/l). The assay is linear up to 2 g/l glucose
 Starch 2.2%, pH 5.0
(Prepare fresh before use; will be diluted by enzymes to 2%)
 Dissolve 1.1 g of corn starch in 50 ml of water in a boiling water bath
 Add 1 ml of 3M NaAc buffer pH 5.0

Procedure:
1. Aliquot starch into 96w PCR plate 150 μl/well (one well for each sample to be measured)
2. Aliquot HK reagent into 96 w assay plate 200 μl/well (two wells for each sample to be measured)
3. Add 16.7 μl of enzyme sample (cells supernatant) into starch, mix and immediately take 10 μl and mix into 200 μl of HK reagent (control sample at t=0). Cover with plate film and incubate HK plate at 30 C. for ≥30 min
4. Incubate enzyme/starch samples at 35° C. for 3 h in PCR machine
5. Take 10 μl of enzyme/starch samples and mix with 200 μl of HK reagent (t=3 h samples). Cover with plate film and incubate HK plate at 30 C. for ≥30 min
6. Measure absorbance of both HK plates at 340 nm
Amylolytic activity [A] calculation (g/L glucose released):

$$A = \frac{OD_{340}[t=3h] - OD_{340}[t=0]}{S \text{ (slope)}} \text{ g/L}$$

Should use supernatant of cell cultures with the same growth OD. If cells are grown differently, the activity should be normalized by cells density
Maltose Assay
Reagents:
Maltose 2.2%:
1.1 g D-maltose
1 mL 3M sodium acetate buffer pH5.0
Bring to 50 mL with water
Hexokinase (HK) reagent (see Starch-GHK assay)
Procedure:
1. Aliquot 150 μL maltose solution into 96 w PCR plate
2. Add 16.7 μL supernatant to the maltose solution
3. Incubate at 35 C. in PCR machine for 3 h (during the last hour get GHK reagent from freezer and allow to thaw at room temperature—do not heat. One 50 mL tube containing 22 mL reagent is sufficient to do one 96 well plate)
4. Put 10 μL of supernatant/maltose sample into a well of the assay plate (Corning, cat#3641)
5. Add 200 μL of HK reagent and cover with plate film
6. Incubate at 35 C. for ≥35 min
7. Measure absorbance at 340 nm
Amylolytic activity [A] calculation (g/L glucose):

$$A = \frac{OD_{340}[t=3h]}{S \text{ (HK slope)}} \text{ g/L}$$

Should use supernatant of cell cultures with the same growth OD. If cells are grown differently, the activity should be normalized by cells density
Corn Mash Assay
Procedure:
1. Cut 1 mL tips so that there is an opening approximately 4 mm in diameter. Tips do not have to be sterile for this assay.
2. Inoculate strain to be tested in YPD. Grow with shaking for 2-3 days, 35° C. to an $OD_{600}$ of approximately 8-10 (stationary phase).
3. If comparing strains, inoculate strain M0509 in YPD. Grow with shaking for 2-3 days, 35° C. to an $OD_{600}$ approximately 8-10 (stationary phase). This will serve as a negative control in the assay.
4. Per 24-well plate, prepare substrate mix in a final volume of 100 mL:

| Substrate | Stock Solution Amount to add per 100 mL Master Mix | Concentration in Master Mix | Final Concentration in CM assay (96-well plate) |
|---|---|---|---|
| Pretreated wet corn mash (~33% solids; test on LMA and adjust the amount added accordingly) | 12.12 g | 4% | 2% |
| 1M Na citrate (sodium citrate dihydrate) pH 5.0 | 15 mL | 150 mM | 75 mM |
| 100X Anti-fungal/bacterial mix, Sigma #A5955 | 2 mL | 2X | 1X |
| 0.5% NaN3 (sodium azide) in 5 mM Na citrate pH 5.0 | 4 mL | 0.02% | 0.01% |
| dH20 | Bring volume to 100 mL | — | — |

5. Using cut tips, add 2 mL/well of the substrate mix prepared above to a 24-well plate. Use continuous stirring with a magnetic stirrer while dispensing the substrate. 3 replicates for each strain/condition are recommended.
6. Add 2 mL of supernatant to be assayed to each well that contains substrate mix.
7. Put 24-well reaction plate into shaker and incubate at 35° C. and 250 rpm.
8. Samples taken at 24 and 48 h sample by allowing the substrate in the plate to settle either by gravity or by centrifugation. Then transfer 150 μL of supernatant to a centrifuge tube with a 0.2 μm filter insert or a 96-well, 0.2 μm filter plate (Fisher: Millipore part # MSGVN2250) with 7.5 μL 10% sulfuric acid added. After filtration, transfer the sample to a total recovery HPLC vial for analysis on the H-column.
Corn Fiber Assay
Procedure:
1. Cut 5 mL tips so that there is an opening approximately 4 mm in diameter. Tips do not have to be sterile for this assay.
2. Inoculate strain to be tested in YPD. Grow with shaking for 2-3 days, 35° C. to an $OD_{600}$ of approximately 8-10 (stationary phase).
3. If comparing strains, inoculate strain M0509 in YPD. Grow with shaking for 2-3 days, 35° C. to an $OD_{600}$ approximately 8-10 (stationary phase). This will serve as a negative control in the assay.
4. Per 24-well plate, prepare substrate mix in a final volume of 100 mL:

| Substrate | Stock Solution Amount to add per 100 mL Master Mix | Concentration in Master Mix | Final Concentration in assay |
|---|---|---|---|
| Washed fermentation residuals (~90% solids; test on LMA and adjust the amount added accordingly) | 4.4 g | 4% | 2% |
| 1M Na citrate (sodium citrate dihydrate) pH 4.0 | 15 mL | 150 mM | 75 mM |
| 0.5% NaN3 (sodium azide) in 5 mM Na citrate pH 5.0 | 4 mL | 0.02% | 0.01% |
| dH20 | Bring volume to 100 mL | — | — |

5. Using cut tips, add 2 mL % well of the substrate mix prepared above to a 24-well plate. Use continuous stirring with a magnetic stirrer while dispensing the substrate. 3 replicates for each strain/condition are recommended.
6. Put 24-well reaction plate into shaker and incubate at 35° C. and 250 rpm.
7. Add 2 mL of supernatant to be assayed to each well that contains substrate mix.

Samples taken at 24 and 48 h sample by allowing the substrate in the plate to settle either by gravity or by centrifugation. Then transfer 150 µL of supernatant to a centrifuge tube with a 0.2 µm filter insert or a 96-well, 0.2 µm filter plate (Fisher: Millipore part # MSGVN2250) with 7.5 µL 10% sulfuric acid added. After filtration, transfer the sample to a total recovery HPLC vial for analysis on the H-column.

CMC Conversion Assay
Procedure:
1. Inoculate strains to be tested in 10 mL YPD (or other media) in 50 ml tubes and grow with shaking for 3 days
2. Prepare the 1.14% CMC substrate, 1.14 g CMC per 100 mL citrate buffer (50 mM pH5.5) autoclaved for 20-25 min. Agitate to make sure all CMC is dissolved
3. To 44 mL of 1.14% CMC add 1 mL of 0.5% of sodium azide
4. Spin cells in 50 ml tubes at max speed for 10 min
5. Add CMC to deep well 96-well plate, 450 µL, well
6. Do 4 replicates for each strain
7. Aliquot 100 µL of DNS into 96-well PCR plate
8. Add 50 µL of yeast supernatant or buffer to the substrate and mix by pipetting
9. Take T=0 sample: transfer 50 µL to the 96-well PCR plate containing DNS and mix
10. Put the deep well plate at 35° C. 800 rpm
11. Heat the PCR plate at 99° C. for 5 min and cool down to 4° C. in PCR machine
12. Transfer 50 µL to microtiter plate
13. Measure absorbance at 565 nm
14. Take samples from reaction plate after 24 and repeat steps 6-12
15. Calculate % of CMC converted at time 24 hrs using formula:

$$Y = \frac{(OD(T=24) - OD(T=0)) \times 100\%}{S \times A} = \frac{\Delta OD \times 100}{0.1 \times 10} = \Delta OD \times 100$$

Y—% of CMC converted at 24
S—DNS/glucose calibration slope that is 0.1 for DNS from May 8, 2007 at 565 nm
A—CMC concentration at T=0 that is 10 g/L for 1% CMC
Reagents:
Dinitrosalicylic Acid Reagent Solution (DNS), 1%
(Could be stored at 4° C. for several months)
   3,5-dinitrosalicylic acid: 10 g
   Sodium sulfite: 0.5 g
   Sodium hydroxide: 10 g
   Add water to: 1 liter
Calibrate DNS by glucose (use glucose samples with conc. 0, 1, 2, 3, 4, 5, 6, 7, 8, 9, 10 g/l, calculate the slope [S], for DNS from May 8, 2007 S=0.1)

Avicel Conversion Assay (High Throughput)
Procedure:
1. Inoculate strains to be tested in 600 ul YPD in deep 96-well plate. Perform 4 repeats for each strain or 4 transformants for each transformation. Grow with shaking for 3 days at 30° C.
2. Spin cells at max speed for 10 min
3. Prepare substrate mix:
   Substrate mix for full 96-well plate, total volume 30 ml:
   0.6 g Avicel (2%)
   500 µl 3M Na Ac pH 5.0 (50 mM)
   1.2 ml 0.5% Na Azide (0.02%)
   30 µl BGL (Novozyme-188, Sigma)
   Add dH20 to 30 ml
4. Add substrate to new deep 96-well plate, 300 µl/well. Shake between additions; do not let the Avicel settle
5. Add 300 µl of yeast spined supernatant or buffer to the substrate.
6. Take T=0 sample: by multichannel pipette mix the reaction mix and transfer 100 µl to 96-well PCR plate
7. Put deep 96-well reaction plate into shaker at 35° C. and 800 rpm
8. Spin 96-well PCR plate with T=0 samples at 2000 rpm for 2 min
9. Aliquot 100 µl of DNS into new 96-well PCR plate
10. Carefully (without touching pellet) take 50 µl of super from T=0 spined 96-well PCR plate and mix it into DNS
11. Heat at 99° C. for 5 min and cool down to 4° C. in PCR machine
12. Transfer 50 µl to micro titre plate
13. Measure absorbance at 565 nm by plate reader
14. Take samples from reaction plate after 24 and 48 hrs and repeat steps 6-13
15. Calculate % of Avicel converted at time 24 and 48 hrs using formula:

$$Y = \frac{(OD(T=24 \text{ or } 48) - OD(T=0)) \times 100\%}{S \times A} = \frac{\Delta OD \times 100}{0.1 \times 10} = \Delta OD \times 100$$

Y—% of Avicel converted at 24 or 48 hrs
S—DNS/glucose calibration slope that is 0.1 for DNS from May 8, 2007 at 565 nm
A—Avicel concentration at T=0 that is 10 g/L for 1% Avicel
Reagents:
Dinitrosalicylic Acid Reagent Solution (DNS). 1%
(Could be stored at 4° C. for several months)
   3,5-dinitrosalicylic acid: 10 g
   Sodium sulfite: 0.5 g
   Sodium hydroxide: 10 g
   Add water to: 1 liter
Calibrate DNS by glucose (use glucose samples with conc. 0, 1, 2, 3, 4, 5, 6, 7, 8, 9, 10 g/l, calculate the slope [S], for DNS from May 8, 2007 S=0.1)

24-Well PHW Assay
Procedure:
1. Patch all strains to be tested including all controls on selective media plates. Incubate for 2 days
2. Inoculate strains to be tested in 4 ml YPD in 24 well plates (autoclaved) in triplicates. Cover plates with two sticky Rayon Films for Biological Cultures (VWR). Grow with shaking for 2-3 days, 35° C. at 225 rpm (attach plates on sticky pads in the fermentation lab shaker)
3. Per 24-well plate, prepare substrate mix in a final volume of 100 mL:

| Substrate | Stock Solution Amount to add per 100 mL Master Mix | Concentration in Master Mix | Concentration in PHW assay |
|---|---|---|---|
| MS149 Pretreated wood (~48% solids) | 8.3 g | 4% | 2% |
| CaCO$_3$ | 0.30 g | 3 g/L | 1.5 g/L |
| 1M Na citrate (sodium citrate dihydrate) pH 5.4 | 15 mL | 150 mM | 75 mM |
| 100X Anti-fungal/bacterial mix, Sigma #A5955 | 2 mL | 2X | 1X |
| Novozyme-188 β-glucosidase (141 mg/mL) | 100 ul | 0.140 mg/mL | 0.070 mg/mL |
| dH20 | Bring volume to 100 mL | — | — |

4. If testing for synergy with other enzymes, aliquot additional enzymes into appropriate wells (for instance, for synergy with yeast made CBHs, mix purified CBH1 and CBH2 to reach ratio 1:1 and aliquot the mix for the final concentration 2 mg CBH/g DW PHW). 24 well plates and tips for this assay don't have to be sterile 5. Using 5 mL cut tips, add 2 mL/well of the substrate mix prepared above to a 24-well assay plate. Use continuous stirring with a magnetic stirrer while dispensing the substrate 6. Spin cultures to be tested in 24 wp at 3000 rpm for 5 min 7. Add 2 mL of supernatants to 24-well assay plate with substrate mix using multichannel pipette with adjustable spacer for 100-1200 µl (Rainin)

8. For negative control, strain M0509 or empty vector strains could be used. For the positive control, dilute Zoomerase to 160 µg/mL (4 mg/g DW PHW) in negative control strain supernatant 9. Take T=0 sample by allowing the substrate in the plate to settle either by gravity or by centrifugation. Then transfer 200 µL of supernatant to 96 PCR wp using multichannel pipette with adjustable spacer for 20-300 µl (Rainin). The samples could be frozen at this point for future analysis 10. Put 24-well assay plate into shaker and incubate at 35° C. at 225 rpm (attach plates on sticky pads in the fermentation lab shaker)

11. Take subsequent time points, preferably 24 and 48 hours

12. For HPLC analysis aliquot 5 µL 10% sulphuric acid into 96 wp with filters (Millipore, MSGVN2250). Add 100 µl of samples. After filtration (using vacuum in analytical lab), transfer the samples to a total recovery HPLC vials for analysis on the H-column. Multichannel pipette with adjustable spacer for 20-300 µl (Rainin) could be used for transfer to make it faster. 96-well collection plate used to collect filtered samples could be recycled 13. Glucose and xylose concentration in the samples also could be measured by kits (see separate protocols)

Mini Vials Fermentation Assay
Procedure for Corn Mash:
1) Determine the solids content of the mash by drying it at 105° C. and weighing
2) Weigh liquid corn mash into the 10 mL pressure bottles according to the desired final % of solids
3) To each bottle add penicillin to final concentration 0.006 mg/mL, urea to final concentration 500 PPM, and water if needed to reach final weigh 4 g.
4) Add desired enzyme to each bottle.
5) Add yeast cells inoculum to final conc. 0.1 g/L DCW.
6) Cap each bottle and insert the 23 gauge needle into the stopper.
7) Incubate the bottles at desired temperature at 125 rpm.
8) At 72 hours, harvest samples and measure ethanol concentration by HPLC analysis.

Procedure for Corn Flour
1) Mix corn flour with water according to desired final concentration
2) Add penicillin to final concentration 0.006 mg/mL and urea to final concentration 700 PPM
3) Weigh liquid substrate mix into the 10 mL pressure bottles according to the desired final % of solids.
4) Add desired enzyme to each bottle.
5) Add yeast cells inoculum to final concentration 0.1 g/L DCW.
6) Cap each bottle and insert the 23 gauge needle into the stopper.
7) Incubate the bottles at desired temperature at 125 rpm.
8) At 72 hours, harvest samples and measure ethanol concentration by HPLC analysis.

Shake Flask Fermentation
Procedure for Corn Mash:
1) Inoculate yeast into 50 mL of YPD and incubate for 15-18 hrs at 35° C. at 200 rpm
2) Spin cell down in 50 mL Falcon tubes, resuspend in 50 mL of water and spin again.
3) Resuspend cells in 10 mL of sterile water and determine dry cell weigh concentration by liquid moister analyzer (Sartorius).
1) Determine the solids content of the mash by drying it at 105° C. and weighing
2) Add mash into shake flasks according to desired final solids concentration
3) Add penicillin to final concentration 0.006 mg/mL, urea to final conc. 500 PPM, and water if needed to reach final weigh 50 g.
4) Add desired enzyme to each flask.
5) Dilute 0.005 g of cells in 1 mL of water and add cells to the flask (0.1 g/L inoculum)
6) Take 1 mL samples at T=24 h, T=48 h and T=72 h. Dilute samples 4× and measure ethanol and sugars concentration by HPLC analysis.

Procedure for Corn Flour:
1) Inoculate yeast into 50 mL of YPD and incubate for 15-18 hrs at 35 C. at 200 rpm
2) Spin cell down in 50 mL Falcon tubes, resuspend in 50 mL of water and spin again.
3) Resuspend cells in 10 mL of sterile water and determine dry cell weigh concentration by liquid moister analyzer (Sartorius).
4) Mix corn flour with water according to desired final conc.
5) Add penicillin to final conc. 0.006 mg/mL and urea to final conc. 700 PPM
6) Weigh liquid substrate mix into shake flasks according to the desired final % of solids.
7) Add desired enzyme to each flask.
8) Dilute 0.005 g of cells in 1 mL of water and add cells to the flask (0.1 g/L inoculum) Take 2 mL samples at T=24 h, T=48 h and T=72 h. Measure ethanol and sugars concentration by HPLC analysis.

Xylan Assay
1. Prepare a substrate solution: 1,0% Birchwood 4-O-methyl glucuronoxylan (Sigma) in 0.05 M Na-citrate buffer, pH 5.0. Homogenize 1.0 g in 80 ml buffer at 60° C. and heat to boiling point, on a magnetic stirrer. Cool with continued stirring, cover and stir slowly overnight. Make up to 100 ml with buffer. Store at 4° C. for a maximum of 1 week or freeze aliquots of e.g. 25 ml at −20° C.
2. Aliquot 150 μl of substrate into 96-well PCR plate
3. Add 16.7 μl of enzyme containing supernatant
4. Incubate at 35° C. for 3 h
5. Remove 25 μl of assay sample and mix with 50 μl DNS in a PCR plate
6. Boil at 99° C. for 5 min; cool at 4° C.
7. Transfer 50 μl to flat bottom coming plate
8. Read absorbance at 540 or 565 nm Xylan Plate Assay
1. Prepare substrate: mix 0.1% Azurine-Crosslinked Xylan (Megazymes) with 1.5% agar in water and autoclave for 20 min
2. Pore substrate on pre-made YPD plates and wait until solid
3. Patch yeast colonies and incubate at 35° C. for 24-48 hrs.

Esterase Assay (for AXE and FAE)
1. Prepare substrate: 1M 4-Nitrophenyl acetate (Sigma N-8130) in methanol or DMSO
2. Dilute substrate to 1 mM by 50 mM Na-Citrate buffer pH5.4
3. Put 50 μl of enzymes containing yeast supernatants or controls into a 96-well analytical plate
4. Add 100 μl 4-Nitrophenyl acetate preheated (35° C.) substrate
5. Read absorbance at 410 nm over a given time course: e.g. 30 min, 1 hr and 2 hours. Incubate sample plate at 35° C. between time points.
6. Reaction can be stopped by adding 100 μl $Na_2CO_3$ (1 M).

Arabinofuranosidase Assay
1. Prepare substrate: 1M 4-Nitrophenyl α-L-arabinofuranoside (pNPA) (Sigma N-3641) in methanol
2. Dilute substrate to 1 mM by 50 mM Na-Citrate buffer pH5.4
3. Put 20 μl of enzymes containing yeast supernatants or controls into a 96-well analytical plate
4. Add 180 μl 4-Nitrophenyl acetate preheated (35° C.) substrate
5. Read absorbance at 405 nm over a given time course: e.g. 30 min, 1 hr and 2 hours Incubate sample plate at 35° C. between time points
6. Reaction can be stopped by adding 100 μl $Na_2CO_3$ (1 M)

PWC (Pretreated Wet Cake) Assay
1. Prepare substrate mix (70 ml for one 24-well plate): 8 g of 35% PWC (modified distiller's dried grains (MDDG) pretreated at 160 C. for 20 min), 7 ml 0.5% NaAz, 5.25 ml of 1 M Na Citrate pH5, 0.7 ml of 100× anti-fungal/bacterial mix (Sigma#A5955), and water to final volume 70 ml
2. Aliquot purified enzymes into 24-well deep plate in desired amount (under 200 μl)
3. Add 2 ml of enzymes containing yeast supernatants or supernatant of empty strain (no enzymes) as control
4. Add 2 ml of substrate mix
5. Incubate at 35° C. with shaking for 48 hrs
6. Take 200 μl samples at T=0, T=24, T=48 hrs (allow the substrate in the plate to settle either by gravity or by centrifugation) into 96-well PCR plate.
7. Spin down PCR plate and transfer 100 μL of supernatant to 96-well, 0.2 μm filter plate (Fisher: Millipore# MSGVN2250) with 5 μL 10% sulphuric acid added.
8. Use filtered sample to measure ethanol and sugars concentration by HPLC.

Xyloglucanase Assay (96-Well Plate)
70 μL of supernatant of 3 day old $2 \times SC^{-ura}$ cultures were added to 280 μL of 50 mM Na-Acetate buffer (pH 5.0) containing 0.5% AZCL (Azurine-Crosslinked) tamarind xyloglucan (Megazyme catalog # I-AZXYG) in a 96-well deep plate
The plate was incubated in a microtiter plate shaker at 35° C. at 800 rpm agitation Samples of 100 μL were taken at 0, 60 and 180 minutes of incubation into 96-well PCR plate spun down at 3000 rpm for 2 min after which 50 μL of the supernatant was placed in a fresh 96-well analytical plate and OD at 600 nm was measured Xyloglucanase Plate Assay
Plates containing 1.5% agar+YPD were overlain with 0.1 or 0.5% AZCL (Azurine-Crosslinked) tamarind xyloglucan (Megazyme catalog #I-AZXYG) in 1.5% agar and spotted with 2 μL of overnight yeast culture. Plates were incubated overnight at 35° C. Blue zone indicated hydrolysis of substrate Pullulan Assay
1. Add 150 μl of 1% pullulan (in 100 mM NaCitrate buffer pH5.0) to each well
2. Mix 16.7 μl of enzyme supernatant
3. Incubate 3 h at 35° C. with shaking (900 rpm)
4. Remove 25 μl of assay sample and mix with 50 μl DNS (the same as in starch assay) in a PCR plate
5. Boil at 99° C. for 5 min; cool at 4° C.
6. Transfer 50 μl to flat bottom coming plate
7. Read absorbance at 565 or 540 nm Pectin Assay
1. Made 0.1% pectin solution (0.05 g of apple pectin in 50 mL of 100 mM sodium citrate buffer pH 5.0; heat to dissolve)
2. Put 50 μL enzyme containing supernatants into wells of new 96 deep well plate (5 μL multifect pectinase in M0139 supernatant for total of 50 μL)
3. Added 450 μL pectin solution
4. Incubated at 35° C. 900 rpm for 4 hr
5. Aliquot 100 μL DNS (same as in starch assay) into 96-well PCR plate
6. Added 50 μL pectin/supernatants solution to DNS and heated at 99° C. for 5 min followed by cooling down to 4° C.
7. Transferred 50 μL to assay plate (flat-bottomed) and measured absorbance at 565 nm or 540 nm Modified Avicel Assay Protocol:
Procedure:
Inoculate strains to be tested in 600 ul YPD in deep 96-well plate. Do 4 repeats for each strain or 4 transformants for each transformation. Grow with shaking for 3 days at 30° C.
1. Spin cells at max speed for 10 min
2. Prepare substrate mix:
    Substrate mix for full 96-well plate, total volume 30 ml:
    0.6 g Avicel (2%)
    500 μl 3M Na Ac pH 5.0 (50 mM)
    1.2 ml 0.5% Na Azide (0.02%)
    30 μl BGL (Novozyme-188, Sigma)
    600 μl Zoomerase from 1 mg/ml stock (to get 1 mg/gm of avicel
    Add dH20 to 30 ml.
3. Add substrate to new deep 96-well plate, 300 ul/well. Shake between additions, don't let Avicel to settle.
4. Add 300 μl of yeast spined supernatant or buffer to the substrate.
5. Take T=0 sample: by multichannel pipette mix the reaction mix and transfer 100 μl to 96-well PCR plate
6. Put deep 96-well reaction plate into shaker at 35° C. and 800 rpm
7. Spin 96-well PCR plate with T=0 samples at 2000 rpm for 2 min 8. Aliquot 50 µl of DNS into new 96-well PCR plate
9. Carefully (without touching pellet) take 25 µl of super from T=0 spined 96-well PCR plate and mix it into DNS
10. Heat at 99° C. for 5 min and cool down to 4° C. in PCR machine
11. Transfer 50 µl to micro titre plate.
12. Measure absorbance at 540 nm by plate reader
13. Take samples from reaction plate after 2 and 4 hrs and repeat steps 6-13
14. Calculate % of Avicel converted at time 2 and 4 hrs using formula:

$$Y = \frac{(OD(T=24 \text{ or } 48) - OD(T=0)) \times 100\%}{S \times A} = \frac{\Delta OD \times 100}{0.25 \times 10} = \Delta OD \times 40$$

Y—% of Avicel converted at 24 or 48 hrs
S—DNS/glucose calibration slope that is 0.25 for DNS at 540 nm
A—Avicel concentration at T=0 that is 10 g/L for 1% Avicel
Reagents:
Dinitrosalicylic Acid Reagent Solution (DNS), 1%
(Could be stored at 4° C. for several months)
    3,5-dinitrosalicylic acid: 10 g
    Sodium sulfite: 0.5 g
    Sodium hydroxide: 10 g
    Add water to: 1 liter
    Calibrate DNS by glucose (use glucose samples with conc. 0, 1, 2, 3, 4, 5, 6, 7, 8, 9, 10 g/l, calculate the slope [S], for DNS S=0.25)

Concentration Determination of TeCBH1-HgCBM-C and ClCBH2b in Media by HPLC Analysis For determination of the concentration of CBHs produced by strains expressing TeCBH1-HgCBM-C (M1111, expressing plasmid pMU1392) and ClCBH2b (M1873), a phenyl reversed phase method was developed on an Agilent 2100 HPLC with the MWD detector at 214 and 280 nm. In this method, the purified CBHs described above were used for generating a standard curve from 200-10 µg. The sample was injected onto a phenyl RP column (Tosoh phenyl-5PW RP, 4.6 mm×7.5 cm, 10 µm) that was equilibrated at 55° C. in 0.1% trifluoracetic acid (TFA) (w/v), 20% acetonitrile. The protein was eluted from the column at 0.75 ml/min using a linear gradient of acetonitrile with 0.1% TFA (w/v) from 20-60% in 45 minutes. After cleaning the column with 95% acetonitrile/TFA, the column was re-equilibrated. To determine the concentration of TeCBH1-HgCBM-C and ClCBH2b produced in media by various strains, the peak area of the sample was compared to the standard curve generated from the peak areas of the purified CBHs (µg/µL injected).

Purification of TeCBH1-HgCBM-C and ClCBH2b for Protein Standards in the HPLC Assay.

1 or 1.5 liter of YPD medium was inoculated with a 10%/o volume of an overnight pre-culture of the strain producing CBH1 or CBH2 (M1111, expressing plasmid pMU1392 and M1873, respectively). The cultures were grown with shaking (210 rpm) at 30° C. After 3 days of cultivation the supernatants were harvested by removing the cells by centrifugation. The supernatants were concentrated and changed into 50 mM sodium acetate (pH 5) with a 10 kDa cut-off Pellicon PTGC membrane (Millipore). The CBH1 sample was loaded into DEAE Sepharose FF column equilibrated with 50 mM sodium acetate, pH 5.0. The bound CBH1 was eluted with linear salt gradient of from 0 to 0.35 M NaCl. The elution volumes were 15 and 20 column volumes. The fractions were tested for CBH1 activity with MULac by incubating 10 µl sample with 90 µl 2 mM MULac in 50 mM NaAc (pH 5.0), in ambient temperature for 20 minutes and stopping the reaction with 0.5 M Na$_2$CO$_3$. The fluorescence was measured with a Varioscan (Thermo Labsystems) microtiter plate reader (ex. 355 nm and em. 460 nm). The CBH1 proteins were visualized on SDS-PAGE and the fractions containing a single band were pooled and changed into 50 mM sodium acetate (pH 5) using 20 ml spin concentrators, 10 kDa MWCO (Vivaspin, Vivascience GmbH). A second step was then carried out in the purification where a 5 ml GE phenyl HR column was utilized to further remove media components. In this procedure, the column was equilibrated with 25 mM sodium acetate, 1.2 M ammonium sulfate, pH 5. Ammonium sulfate was added to the sample to bring the concentration in the buffer to 1.2 M and this material was injected onto the column. The protein was eluted with a linear gradient of 25 mM sodium acetate, pH 5 and fractions that were active on MULac were pooled. Purity was assessed by SDS-PAGE and concentration was determined by absorbance at 280 nm using the theoretical absorptivity value. ClCBH2b was purified using the same chromatography steps, DEAE anion exchange followed by phenyl HIC. In this purification, ClCBH2b is found in the flow through of the DEAE step and was eluted from the phenyl HIC column within the decreasing ammonium sulfate gradient. Active fractions were determined using a 1% Avicel hydrolysis assay at pH 5.0 as described above. Purity and concentration determination were determined as described above.

PHW assay
1. Prepare substrate mix (100 mL per one 24-well plate): 8.3 g of pretreated wood (48% of solids), 20 ml of 1M Na Citrate pH4.8, 2 ml of 100× anti-fungal/bacterial mix (Sigma#A5955), and water to final volume 100 ml. In some assay 0.222 ml of commercial glucoamylase (AB Enzymes#EL2008044L 63 ml/ml) is added (heat treated to remove side activities)
2. Add purified enzymes into wells of 24-well deep plate (under 200 µl)
3. Add 2 mL of enzymes containing yeast supernatants and empty strain supernatant as control
4. Using cut 5 ml tips, add 2 ml/well of the substrate mix to enzymes. Use continuous stirring with a magnetic stirrer while dispensing the substrate
5. Incubate 24-well reaction plate at 38° C. and 250 rpm
6. Take 200 µl samples at T=0, T=24, T=48 hrs (allow the substrate to settle in the plate either by gravity or by centrifugation) into 96-well PCR plate
7. Spin down PCR plate and transfer 100 µL of supernatant to 96-well, 0.2 µm filter plate (Fisher. Millipore#MSGVN2250) with 5 µL 10% sulphuric acid added
8. Use filtered sample to measure ethanol and sugars concentration by HPLC Paper Sludge Assay
1. Prepare substrate mix (100 mL per one 24-well plate): 10.5 g of paper sludge (38% of solids), 40 ml of 1M Na Citrate pH5.2, 2 ml of 100× anti-fungal/bacterial mix (Sigma#A5955), and water to final volume 100 ml. In some assays 0.222 ml of commercial thermostable β-glucosidase (AB Enzymes 63 ml/ml) is added (heat treated to remove side activities)
2. Add purified enzymes into wells of 24-well deep plate (under 200 µl)
3. Add 2 mL of enzymes containing yeast supernatants and empty strain supernatant as control
4. Using cut 5 ml tips, add 2 ml/well of the substrate mix to enzymes. Use continuous stirring with a magnetic stirrer while dispensing the substrate
5. Incubate 24-well reaction plate at 35° C. and 250 rpm
6. Take 200 µl samples at T=0, T=24, T=48 hrs (allow the substrate in the plate to settle either by gravity or by centrifugation) into 96-well PCR plate 7. Spin down PCR plate and transfer 100 μL of supernatant to 96-well, 0.2 μm filter plate (Fisher. Millipore#MSGVN2250) with 5 μL 10% sulphuric acid added
8. Use filtered sample to measure ethanol and sugars concentration by HPLC.

1-Napthyl-acetate esterase assay

1. Inoculate SC or YPD medium with the stain to be tested and incubate on a rotary shaker.
2. Remove the cells by centrifugation.
3. Set up the reaction as follows in a 96 well plate:

| | | |
|---|---|---|
| 88 μL | Citrate buffer (50 mM, pH 5.0)* | |
| 10 μL | Supernatant | |
| 2 μL | 1-naphtyl-acetate in ethanol (500 mM)** | |
| 100 μL | Total | |

**(Sigma 46010)
*(Phosphate buffer can also be used but Acetate buffers cause a precipitate)

4. Incubate for 5-30 min at 35° C. The incubation time depend on the level of activity.
5. Stop the reaction by adding 100 μl 0.01% Fast Corrinth V salt solution.
6. Read 100 μL at 535 nm

50 mM Citrate Buffer pH 5.0

| | |
|---|---|
| 1M Citric acid | 20.5 mL |
| 1M Na-citrate | 29.5 mL |

This is 50 mL 1M Citrate Phosphate buffer (pH 5.0). Dilute to appropriate concentration with water.

500 mM 1-naphtyl-acetate (Mr 186 g/mol)

| | |
|---|---|
| 1-naphtyl-acetate | 0.0931 g |
| Ethanol (100%) | 1000 μl |

(make fresh batch each day)

Fast Corrinth V Salt Solution (Sigma 227366)

| | | |
|---|---|---|
| Fast Corrinth V salt (0.01%) | 0.001 | g |
| Tween 20 (10%) | 1 | mL |
| 1M Na-Acetate buffer pH 4.4 | 9 | mL |
| | 10 | mL |

NB: Make this solution fresh each day and keep in a dark bottle—use same day, very light sensitive.
1-Naphtol (for standard curve) (Sigma 31097)
Prepare a 1 g/L 1-naphtol solution in the buffer used for the assay to set the standard curve.
Set the standard cure between 0.025 g/L and 0.4 g/L

Alpha-galactosidase Activity Assay using NpGal

Reference: Margolles-Clark et al. 1996. *Eur J Biochem.* 240: 104-111.

1. Prepare solutions as indicated below
2. Patch colonies to be screened on selection plates and incubate at 30-35° C. for 48 h
3. Inoculate 600 μl YPD in 96 well plate and incubate at 35° C. with 800 rpm shaking for 48-72 h
4. Spin cells for 2 min at 2500 rpm
5. Place 20 μl supernatant into a 96 well plate
6. Add 180 μl NpGal preheated (35° C.) substrate
7. Incubate for given time course at 35° C.: e.g. 30 min, 1 hr and 2 hours (may have to go overnight according to some enzymes in literature)
8. Read absorbance at 405 nm over a given time course. Incubate sample plate at 35° C. between time points
9. Stop reaction by adding 100 μl $Na_2CO_3$ (1 M)

1 mM p-nitrophenyl-α-D-galactopyranoside (NpGal) (Sigma N0877) 301.3/mol)

Make a 1M Stock=0.151 g in 500 μl methanol or DMSO
1 mM Stock=10 μl of 1M stock in 9.99 ml citrate buffer

| |
|---|
| Citrate-Buffer (0.05M pH 5.4) 1 L |

0.1M Citric acid: 21.01 g citric acid in 1000 ml $H_2O$
0.1M Sodium citrate: 29.41 g of $C_6H_5O_7Na_3 \cdot 2H_2O$ in 1000 ml $H_2O$
20.5 ml of citric acid + 29.5 ml of sodium citrate, add $dH_2O$ to a total of 100 ml

INCORPORATION BY REFERENCE

All documents cited herein, including journal articles or abstracts, published or corresponding U.S. or foreign patent applications, issued or foreign patents, or any other documents, are each entirely incorporated by reference herein, including all data, tables, figures, and text presented in the cited documents.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (555 sequences)

SEQ ID NO: 1 - DNA, 1380 bp, Aspergillus fumigatus
atgttgttgcaagcttttttgtttttgttggctggttttgctgctaaaatttctgctcaacaaccagctgcttcttctgctggtaatccaaaattgactacttacaagtgtactactgcaggtggttgtgttgctcaagatacttctgttgttttggattggggttatcattggattcatactgttgatggttatacttcttgtactacttcttctggtgttgattctactttgtgtccagatgctgctacttgtgctaaaaactgtgttattgaaccagctaattatacatctgctggtgttactacttctggtgattctttgacaatgtaccaatacgttcaatctaatggtgtttacactaatgcttctccaagattgtatttgttgggtccagataaaaactacgtcatgttgaagttgttgggtcaagaattgacttttgatgttgatttgtctactttgccatgtggtgaaaatggtgctttgtatttgtctgaaatgtctgctactggtggtagaaatgaatacaatactggtggtgctgaatatggttctggttattgtgatgctcaatgtccagttattgcttggaaaaatggtactttgaatacatctggtgcttcatattgttgtaacgaaatggatattttggaagctaattctagagctaattcttatactccacatccatgttctgctactgattgtgataaaggtggttgtggttttaatccatatgctttgggtcaaaaatcttattggggtccaggtggtactgttgatacttctaagccattcactattactactcaattcattacaaacgatggtactactactggtactttgtcagaaattagaagacaatacatgcaaaacggtaaggttattgctaatgctgtttcttctacaggtgttaactctattactgaagattggtgtacttcagttgatggttctgctgctacttttggtggtttgactactatgggtaaagctttgggtagaggtatggttttgattttctctatttggaatgatgcttctggttttatgaattggttggattctggtaatgctggtccatgttcttctacagaaggtaatccagatttgattaaggctcaaaatccaactactcatgttgttttctcaaatattagatggggtgatattggttctacttttaaaggttctgatggttctgttactactactacttctacaacttctactaagactactacatctactgctccaggtccaactcaaactcattatggtcaatgtggtggtcaaggttggactggtccaactgcttgtgcttctccatatacttgtcaagttttgaatccatggtactctcaatgcttataa

SEQ ID NO: 2 - DNA, 1407 bp, Neosartorya fischeri
atgttgttgcaagcttttttgtttttgttggctggttttgctgctaaaatttctgctcaacaaccagctacttcttctgctggtaatccaaaattgactacttacaagtgtactactgcaggtggttgtgttgctcaagatacttctgttgttttggattggggttctcattggattcatactgttaatggttacacttcttgtactacatcttctggtgttgattctactttgtgtccagatgaagctacttgtgctaagaattgtgttattgaacctgctaattatacttctgctggtgttgctacttctggtgattctttgacaatgtaccaatacgttcaaaacaatggtgtttacactaatgcttctccaagattgtatttgttgggtccagataaagattacgtaatgttgaagttgttgggtcaagaattgtcttttgatgttgatttgtctactttgccatgtggtgaaaatggtgctttgtatttgtctgaaatgtctgcttctggtggtagaaatgaatacaatactggtggtgctgaatatggttctggttattgtgatgctcaatgtccagttattgcttggaaaaatggtactttgaatacatctggtgcttcatattgttgtaacgaaatggatattttggaagctaattctagagctaattcttatactccacatccatgttctgctactgattgtgataaaggtggttgtggttttaatccatatgctttgggtcaaaaatcttattggggtccaggtggtactgttgatacttctaagccattcactattactactcaattcattacaaacgatggtactactactggtactttgtcagaaattagaagacaatacattcaaaacggtaaggttattgctaatgctgtttcttcagctggtgtttcttctattactgaagattggtgtacatctgttgattcttcagctgctacttttggtggtttgactactatgggtaaagctttgggtagaggtatggttttgattttctctatttggaatgatgcttctggttttatgaattggttggattctggtaattctggtccatgttcttctacagaaggtaatccagatttgattaaggctcaaaatccaactactcatgttgttttctcaaatattagatggggtgatattggttctacttttaagggttctgatgattctggtactacaactactaaaactactactactaagacttctacatctactactagtacaaagactacaacttctactgctccaggtgctactcaaactcattatggtcaatgtggtggtcaaggttggactggtccaactgcttgtgcttctccatatacttgtaaagctcaaaatcaatggtactctcaatgcttataa

SEQ ID NO: 3 - DNA, 1380 bp, Aspergillus clavatus
atgttgttgcaagcttttttgtttttgttggctggttttgctgctaaaatttctgctcaaaatccaggtgctgctgatgctggtaatccaaaattgactacttacaagtgtactactgcaggtggttgtgttaaacaagatacttctgttgttattgattggaactaccattggattcatactgctaatggttatgattcttgtactacttcttctggtgttgattcttctttgtgtcctgatgctgctacttgtgctagaaattgtgttattgaaccagctaattatacatctgctggtgttgctacttctggtgatactttgactatgcatcaatacattaagtctgacggtgaatacgttaatgcttctccaagattgtatttgttgggttcagatggtgattacgttatgatgaaattgttgggtcaagaattgacttttgaagttgatttgtctactttgccatgtggtgaaaatggtgctttgtatttgtctgaaatgtctgctacaggtggtagaaatgaatataacaaaggtggtgctgaatatggttctggttattgtgatgctcaatgtccagttcaaacttggaaaaatggtactttgaacactaatggttcaggtttttgttgtaacgaaatggatattttggaaggtaattctagagctaattcttttactccacatccatgttcttctactgattgtgataaaggtggttgtggttttaatccatatgctttgggtcaacaaaattactggggtccaggtggtactgttgatacttttaagccattcactgttactactcaattcattacttctgatggtactcaaactggtacattgaaagaaattagaagacaatacattcaaaacggtaaagaatggtgtacttctggtgcttcttttggtggtttgactactatgggtcaagctttgggtagaggtatggttttggctttttctatttggaatgataactctcaatttatgaactggttggattctggttctaatggtccatgttcatctacagaaggtaatccagatttgattaaagctcaaaacccaactactcatgttgttttctcaaatattagatggggtgatattggttctactttttctaatccaggtggttcatcttcaagttctactactagaattgttactattactaagccaactactgtttttccaacttctactaagactactactattcaagctccaactactactactacagcttctggtgctactcaaacacaatggggtcaatgtggtggtcaaggttggtcatctccaactgcttgtgctactccatatacttgtcaagctcaaaatgcttggtattctcaatgtgtattataa

SEQ ID NO: 4 - DNA, 1410 bp, Aspergillus terreus
atgttgttgcaagcttttttgtttttgttggctggttttgctgctaaaatttctgctcaacaaccatcttcttcatctccaggtaatccatctttgactacttggaaatgtactactggtggtggttgtttgcaacaagatacttctgttgttttggattggggttttcattggattcatacttctaactctcaatcttgtactacttcttctggtgttaattctgctttgtgtccagatgaagctacttgtgctaagaattgtgttattgatccagctaattatgctactgctggtgttgctacttctggtgatactttgactatgcatcaatactatcaaaacaacggtgttattactaatgcttctccaagattgtatttgttgggttctgatggtaattacgtaatgttgaagttgttgggtcaagaattgtcttttaacgttgatttgtctactttgccatgtggtgaaaatggtgctttgtatttgtctgaaatgtctgctactggtggtagaaatgaatacaatactggtggtgctcaatatggttctggttattgtgatgctcaatctccagttatggcttggagaaatggtactttgaatacttctggtcaaggttttggttgtaacgaaatggatattttggaagctaattctagagctaattcttttactccacatccatgtaatggtaatgattgtgataaaggtggttgtggttttaatccatatgctttgggtcaacaaaattactggggtccaggtggtactgttgatacatctaagccattcactattactactcaattcattactgatgatggtactaaaactggtacattgaaagaaattagaagacaatacattcaaaacggtaagattattgctaatgctaaatcttcagctggtgttgattctattactgaaccatggtgtgaatctgttgatggtgctgctgctacttatggtggtttgaaaagaatgggtgaagctttgggtagaggtatggttttgattttctctatttggaatgatgcaggtggttttatgaattggttggattctggttctgctggtccatgttcttctactgaaggtaacccatctttaattcaatctgctcatccagatactcatgttgttttctcaaatattagatggggtgatattggttctacttatactaatccaggtggttctggttcttcatcttcttctactactacaactactaagactacttctacaacaactactacaaagattactactactacatctgcaggtggtgcaactcaaactcattggggtcaatgtggtggtcaaggttggactggtccaactgcttgtgcttctccatatacttgtcaaaagcaaaatgaatggtactctcaatgcttataa

SEQ ID NO: 5 - DNA, 1383 bp, Trichoderma longibrachiatum
atgttgttgcaagcttttttgtttttgttggctggttttgctgctaaaatttctgctcaacaaccaggtacttctactccagaagttcatccaaaattgactacttacaagtgtactacttctggtggttgtgttgctcaagatacttctgttgttttggattggaattatagatggatgcatgatgctaattacaattcttgtactgttaatggtggtgttaatactactttgtgtccagatgaagctacttgtggtaaaaactgttacattgaaggtgttgattatgctgcttctggtgttactgcttctggttctactttgactttgaatcaatacatgccatcttcatctggtggttattcttcagtttctccaagattgtatttgttgggtccagatggtgaatacgtaatgttgaagttgaatggtcaagaattgtcttttgatgttgatttgtctgctttgccatgtggtgaaaatggttctttgtacttgtctcaaatggatgaaaatggtggtgctaatcaatacaatactgctggtgctaattatggttctggttattgtgatgctcaatgtccagttcaaacttggagaaatggtactttgaatacttctggtcaaggtttttgttgtaacgaaatggatattttggaaggtaattctagagctaatgctttgactccacattcttgtacagctactgcttgtgattctgctggttgtggttttaatccatatggttcaggttatccaaattactttggtccaggtgatactgttgatacttctaagactttcactattattactcaattcaacactgataatggttctccatctggtaatttggtttctattactagaaagtacagacaaaacggtgttgatattccatctgctaaaccaggtggtgatactatttcttcttgtccatctgcttcagcttatggtggtttggctactatgggtaaagctttatcttctggtatggttttggttttttctatttggaacgataactctcaatatatgaactggttggattctggtagagctggtccatgttcttctactgaaggtaatccatctaacattttggctaacaatcctggtactcatgttgtttactcaaatattagatggggtgatattggttctactactaattctactggtggtaatccaccaccacctccacctccagcttcatctactactttttctactactagaagaagttctactacttcttcttctccttcttgtactcaaactcattggggtcaatgtggtggtattggttatactggttgtaaaacttgtacttctggtactacttgtcaatatggtaacgattactactctcaatgcttataa

SEQ ID NO: 6 - DNA, 1482 bp, Penicillium marneffei
atgttgttgcaagcttttttgtttttgttggctggttttgctgctaaaatttctgctcaacaagctccaactccagataatactgtttctttgccaacttggaaatgtacttcttctggtggttgtgttcaacaatctacttctattgttgttgattgggtttatcattggattcatactgttaatggttctacttcttgtactacatcttctggtttaaattctgctttgtgtggtactgaaaaagaatgttacactaactgtgaaatttctccagctacttatgatggtttgggtattagagcttctggtaatgctttgactttgaaccaatacgttacttctaatggtactacaaattctgtttctccaagagtttatttgttggatccagctggtaagaattatgaaatgttgcaattgttgggtcaagaaatttcatttgatgttgatgtttctaatttgccatgtggtgaaaatggtgctttgtatttgtctgaaatggatgctactggtggtagatctcaatataatccagctggtgcttcttatggttctggttattgtgatgctcaatgtggtactggttcttggtttaacggttctattaatactggttcattgggttcttgttgtaatgaaatggatttgtgggaagctaattctcaagctactgctttgactccacatccatgttctgttgatggtccatatggttgttctggttctgcttgtggttctactggtgtttgtgataaaaatggttgtggttttaatccatatgctttgggtgatcataattactatggttcaggttatactgttgatacttctaagccatttactgttactactcaattcgttacatctgatggtacaaaaactggtgctttgactgaaattagaagatcttacgttcaaaacggtaaggttattgctaatgctgttgcttcttcttcatctggtgtttctggtgctaattctattactgaatctttctgtactactatggattctgaagctggtactttgggtggtttgagaactatgggtgaagctttgggtagaggtatggttttgattttctctatttggaatgatgcaggtggttctatgaattggttggattctggtaattctggtccatgttcttctactgctggtgttccatctactattcaagctaatgatccatctacatctgttactttctctaacattaagtggggtgatattggttctacaggtccatctccaggtggttcttcaagttcatcaagttcttcatcaaagtcatcttctactactatttctattactcattctactacttcatcttcagctactactactacaacttctactggtgctactcaaactcattggggtcaatgtggtggtacaggttattctggtccaactgcttgtgctccaccatatacttgtaaagctcaaaatccatactactctcaatgcttataa

SEQ ID NO: 7 - DNA, 1188 bp, Chaetomium globosum
atgttgttgcaagcttttttgtttttgttggctggttttgctgctaaaatttctgctcaacaaccaggttctgttactccagaagttcatccaaaattaccaacttggcaatgtactaaatctggtggttgtgttgaacaagatacttctgttgttttggattggaattacagatggtttcatacttctgataacactacttcttgtactacttcttctggtattgattctactttgtgtccagatgctgctacttgtgctgaaaattgtgttgttgaaggtactgattatacatcttcaggtattgaaacttctggttcttcattgactttaagacaattcgttaaagattctgaaggtaagactaattctgtttctccaagagcttatttgttgggtgctgatggtgattacgtaatgttcaagttgttgaaccaagaattgtcttttgatgttgatgtttctactttgccatgtggtgaaaatgctgctttgtacttttctgaaatggataaaactggtggtagaaatgaacataatactggtggtgcaaaatatggttctggttattgtgatgctcaatgtccagttcaaacttggaacaatggtactttgaatacttctcatcaaggttcttgttgtaacgaaatggatattttggaagctaattctaaagctgaagcttttactccacatccatgtattggtgataattgtgataaaggtggttgtggttttaattcttacgctagaggtaacaaaaattactgggctccaggtggtactttggatacatctaagccatttactatggttactcaattcattactgatgatggtacatcttctggtaaattgtctcaaattgttagatcttacgttcaaaatggtcaaaaagttgcttctgctgtttctggtggtgattctattactgttgaaggttgttcttcttctgatgcttatggtggtttggttggtatgggtgaagctttgggtagaggtatggttttggctatgtctatttggaatgatgcttctggttttatgaattggttggattctggtgataatggtccatgtaatgaaactgaaggtgatccagctaacattttggctaatcatccagattctcaagttgttttgtcaaatattagatggggtgatattgattcaactgttcaattataa

SEQ ID NO: 8 - DNA, 1323 bp, Neurospora crassa
atgttgttgcaagcttttttgtttttgttggctggttttgctgctaaaatttctgctcaacaaattggtactattactccagaatctcatccaaaattgccaactaaaagatgtactttgtctggtggttgtcaaactgtttctacttctattgttttggatgcttttcaaagaccattgcataaaattggtgatccatctactgcttgtgttgttggtggtccattgtgtccagatgctgctacttgtgctgctaattgtgcattggaaggtgttgattatgcttctttgggtgttaaaactgaaggtgatgctttgactttgaatcaatgggtttctgatccatctaatccaggtcattacaaaacatcttctccaagaacttatttggttgctgaagatggtaagaattacgaagctgttaaattgttgggtaaagaaatttcattcgatgttgatgtttctaatttgccatgtggtatgaatggtgctttttacttgtctgaaatgttgatggatggtggtagaggtgaatttaatgctgctggtgctgaatatggtactggttattgtgatgctcaatgtccaaagttggatttcattaatggtgaagctaacattaacaaaactcatggtgcttgttgtaatgaaatggatattttcgaagctaatgctagagctaaatcttttactccacatccatgttctattgaaagggtttacaagtgtactggtgatactgaatgtggtcaatctcaaggtgtttgtgatcaatggggttgtacttataatgaataccaaaagggtgttcatgatttttatggtttggctcctccagctaaaactattgatactactcaaaagttcactgttactactcaatttttgactgataacggtagagaagatggtgttttggttgaaattagaagattgtggtcacaaaacggtaaattgattaagaatgctaagattgctgttgattctttgtctactgattctgtttctacacaattctgtgaaaaaacttcttcttggactatgcaaagaggtggtttgaaaactatgggtgaagctatgggtagaggtatggttttgattttttctatttgggctgatgaatctggttttatgaattggttggattctggtgattcaggtccatgttctgctacagaaggtgatccaaaattgattttgcaaaaaaagccagatgctagagttactttctctaacattaaatggggtgaaatgggttctacttatgcttctgctggtaagtatggtgttagaagagttgctaaaggtttgtctgcattataa

SEQ ID NO: 9 - DNA, 1260 bp, Aspergillus oryzae
atgttgttgcaagcttttttgtttttgttggctggttttgctgctaaaatttctgctcaacaagttggtactactgctgatgctcatccaagattgactacttacaagtgtacttctcaaaatggttgtactagacaaaatacttctttggttttggatgctgctactcattttattcataagaagggtactcaaacttcttgtactaattctaacggtttggatactgctatttgtccagataaacaaacttgtgctgataattgtgttgttgatggtattactgattatgcttcttatggtgttcaaactaagaatgatactttgactttgcaacaatatttgcaaactggtaatgctactaaatctttgtctccaagagtttatttgttggctgaagatggtgaaaattactcaatgttgaagttgttgaaccaagaatttacttttgatgttgatgcttctactttggtttgtggtatgaatggtgctttgtatttgtctgaaatggaagcttctggtggtaaatcttctttgaatcaagctggtgcaaaatatggtactggttattgtgatgctcaatgttatactactccatggattaatggtgaaggtaatactgaatctgttggttcttgttgtcaagaaatggatatttgggaagctaatgctagagctactggtttgactccacatccatgtaatactactggtttgtatgaatgttctggttctggttgtggtgattctggtgtttgtgataaagctggttgtggttttaatccatatggtttgggtgctaaagattattatggttacggtttgaaggttaacactaacgaaactttcactgttgttactcaatttttgactaacgataacactacttctggtcaattgtctgaaattagaagattgtacattcaaaacggtcaagttattcaaaatgctgctgttacttcaggtggtaaaactgttgattctattactaaggatttctgttctggtgaaggttctgcttttaatagattgggtggtttggaagaaatgggtcatgctttgggtagaggtatggttttggctttgtctatttggaatgatgctggttcttttatgcaatggttggatggtggttctgctggtccatgtaatgctacagaaggtaatccagctttgattgaaaaattgtacccagatactcatgttaagttctctaaaattagatggggtgatattggttctacttacagacacttataa

SEQ ID NO: 10 - DNA, 1371 bp, Thielavia heterothallica
atgttgttgcaagcttttttgtttttgttggctggttttgctgctaaaatttctgctcaaactccaggtgaaggtgaagaagttcatccacaaattactacttacagatgtactaaagctgatggttgtgaagaaaagactaactacattgttttggatgctttgtctcatccagttcatcaagttgataatccatacaattgtggtgattggggtcaaaaaccaaatgaaactgcttgtccagatttggaatcttgtgctagaaattgtattatggatccagtttctgattatggtagacatggtgtttctactgatggtacttctttgagattgaaacaattggttggtggtaatgttgtttctccaagagtttatttgttggatgaaactaaagaaagatacgaaatgttgaagttgactggtaatgaatttactttcgatgttgatgctactaaattgccatgtggtatgaactctgctttgtatttgtctgaaatggatgctactggtgctagatctgaattgaatccaggtggtgctacttttggtactggttattgtgatgctcaatgttacgttactccattcattaatggtttgggtaatattgaaggtaaaggtgcttgttgtaacgaaatggatatttgggaagctaatgctagagcacaacatattgctccacatccatgttctaaagctggtccatatttgtgtgaaggtgctgaatgtgaatttgatggtgtttgtgataaaaatggttgtgcttggaatccatatagagttaacgttactgattattatggtgaaggtgcagaatttagagttgatactactagaccattttctgttgttactcaatttagagcaggtggtgatgccggtggtggtaaattggaatcaatttacagattgttcgttcaagatggtagagttattgaatcttacgttgttgataaaccaggtttgccaccaactgatagaatgactgatgaattttgtgctgctacaggtgctgctagatttactgaattgggtgctatggaagctatgggtgatgctttgactagaggtatggttttggctttgtctatttggtggtctgaaggtgataatatgaattggttggattctggtgaagctggtccttgtgatccagatgaaggtaatccatctaacattattagagttcaaccagatccagaagttgttttttctaatttgagatggggtgaaattggttctacttatgaatctgctgttgatggtccagttggtaaaggaaagggtaaaggtaaaggtaaggctccagctggtgatggtaatggtaaagaaaagtctaatggtaagagattcagaagattcttataa

SEQ ID NO: 11 - DNA, 1293 bp, Fusarium oxysporum
atgttgttgcaagcttttttgtttttgttggctggttttgctgctaaaatttctgctcaaactccagataaagctaaagaacaacatccaaagttggaaacttacagatgtactaaagcttctggttgtaagaaacaaactaactacattgttgctgatgctggtattcatggtattagacaaaaaaatggtgctggttgtggtgattggggtcaaaaaccaaatgctactgcttgtccagatgaagcttcttgtgctaagaattgtattttgtctggtatggattctaatgcttacaaaaacgctggtattactacttctggtaacaaattaagattgcaacaattgattaacaaccaattagtttctccaagagtttatttgttggaagaaaacaagaaaaagtacgaaatgttgcatttgactggtactgaattttctttcgatgttgaaatggaaaaattgccatgtggtatgaatggtgctttgtatttgtctgaaatgccacaagatggtggtaaatctacttctagaaattctaaagctggtgcttattacggtgctggttattgtgatgctcaatgttacgttactccattcattaatggtgttggtaacattaaaggtcaaggtgtttgttgtaacgaattggatatttgggaagctaattctagagctactcatattgctccacatccatgttctaaaccaggtttgtatggttgtactggtgatgaatgtggttcttctggtatttgtgataaagcaggttgtggttggaatcataacagaattaacgttactgatttttacggtagaggtaaacaatataaggttgattctactagaaagttcactgttacttctcaatttgttgctaacaaacaaggtgatttgattgaattgcatagacattacattcaagataacaaggttattgaatctgctgttgttaacatttctggtccaccaaagattaatttcattaacgataagtattgtgctgctactggtgctaatgaatatatgagattgggtggtactaaacaaatgggtgatgctatgtctagaggtatggttttggctatgtctgtttggtggtctgaaggtgattttatggcttggttggatcaaggtgttgctggtccatgtgatgctactgaaggtgatccaaagaatattgttaaggttcaaccaaatccagaagttactttctctaacattagaattggtgaaattggttctacttcttctgttaaagctccagcttatccaggtccacatagattataa

SEQ ID NO: 12 - DNA, 1269 bp, Humicola insolens
atgttgttgcaagcttttttgtttttgttggctggttttgctgctaaaatttctgctcaaaaaccaggtgaaactaaagaagttcatccacaattgactacttttagatgtactaaaagaggtggttgtaaaccagctactaatttcattgttgatttgtctttgtctcatccaattcatagagctgaaggtttgggtccaggtggttgtggtgattggggtaatccaccaccaaaagatgtttgtccagatgttgaatcttgtgctaagaactgtattatggaaggtattccagattattctcaatatggtgttactactaatggtacttctttgagattgcaacatattttgccagatggtagagttccatctccaagagtttatttgttggataagactaagagaagatacgaaatgttgcatttgactggttttgaatttactttcgatgttgatgctactaaattgccatgtggtatgaactctgctttgtatttgtctgaaatgcatccaactggtgctaaatctaagtataatccaggtggtgcttattatggtactggttattgtgatgctcaatgttttgttactccattcattaatggtttgggtaatattgaaggtaaaggttcttgttgtaacgaaatggatatttgggaagctaattctagagcttctcatgttgctccacatacttgtaacaaaaagggtttgtacttgtgtgaaggtgaagaatgtgcttttgaaggtgtttgtgataaaaatggttgtggttggaacaattacagagttaacgttactgattattatggtagaggtgaagaatttaaggttaacactttgaagccatttactgttgttactcaatttttggctaatagaagaggtaaattggaaaagattcatagattctacgttcaagatggtaaagttattgaatctttctacactaacaaagaaggtgttccatacactaatatgattgatgatgaattttgtgaagctactggttctagaaaatacatggaattgggtgctactcaaggtatgggtgaagctttgactagaggtatggttttggctatgtctatttggtgggatcaaggtggtaatatggaatggttggatcatggtgaagctggtccatgtgctaaaggtgaaggtgctccatctaatattgttcaagttgaaccatttccagaagttacttacactaatttgagatggggtgaaattggttctacttaccaagaattgcaattataa

SEQ ID NO: 13 - DNA, 1488 bp, Pyrenophora tritici-repentis
atgttgttgcaagcttttttgtttttgttggctggttttgctgctaaaatttctgctgctgttattttgggttgggctagaggttattgtaatagaagatgggattctccaaaatctacttctgaaaagaagtacttcggtattaatactgttgcaatttacaacattgaatctgctgttcaaagattgccatctagaccaagattgcattttttcaaggttttttctatgccaagatacacttttttgactgctgctttggttggtttggcttctgctcaatctttgttgggtactactccagaagttcatccaaaattgaaaacttggaagtgtactaaagcaggtggttgtaaagctgttaattctgctattgttattgatgctggttctcatggtattagacaaaagaacaatccatctttgggttgtggtgattttggttctactccaccaaaatctgtttgtccagataaagaaacttgtgctaagaattgtgttatggatggtatttctgattattctgctttgggtgttactactcaaggttcttcattgagattggacatgttgaactctaaaggtaatgaagcttctccaagagtttatttgttggctgaagatgaaaagaattacgaaatgttgaagttgactggtaatgaatttactttcgatgttgatacttctaaattgccatgtggtatgaatggtgctttgtatttgtctgaaatggctgctaatggtggtagatctaaattgaatccaggtggtgctacttatggtactggttattgtgatgctcaatgttttgttactccatggattaatggtgaaggtaatgttaaaggtcaaggtgtttgttgtaacgaaatggatatttgggaagctaacaaagctgctactcaaattgctccacatacttgttctaagaactctatttttggttgtactggtgatgaatgtggtgcttctggtttgtgtgataaaaatggttgcggtgataatccatacaatcaaagaaaatctccagattattacggtccatctaaaaaagttgatactactaagccatttactgttgttactcaatttccagctaaaaatggtgttttgcaagctattgttagaaaatacgttcaaaacggtaaggttattgaaaatgctatgatgaacttgactatggatcaagctttttgtactgctcaaggtgctacaatgtataacaaattgggtggtcataaaggtatgggtgatgctttgtctagaggtatggttttggctttgtctatttggtgggataaaactggtggtatgaattggttggattctggtgctgctggtccatgttctgctactgaaggttttccagctgaaatcattaaagttgaaccaagaccaactgttactttctcttctattaaatggggtgaaattggttctactttcaaagaacaaggttctactaaagttccattcactgcattataa

SEQ ID NO: 14 - DNA, 1368 bp, Magnaporthe grisea
atgttgttgcaagcttttttgtttttgttggctggttttgctgctaaaatttctgctcaacaaattggtactgaaattccagaaattcatccagaattgccaactcaattttgtactagaaaggatggttgtgttgttagaaagactaagattgttgctgatgtaatgtttagaccaatgcatgttaaggataatgtttctatgccatgtactgctgcttttggtactgctttgtgtccagatgctgctacttgtacaagaaattgtgttttggaaggtgttgattatgattctttgggtgttgctactaaaggtaatgctttgaagttgaaccaatacttgtttaatggtgctgaatacaaaaaagttgctccaagagtttatttgttgggtgaagatgatagaaattacgaattgatgaagttggttaatatggaattggctttcgatgttgatgtttctcaattgggttgtggtatgaatggtgctttgtacttttctgaaatggatgtttctggttctagatctgatttgaatccagctggtgctgcttatggtacaggtgaatgtgatgctcaatgttttcaagatcaaaacttcactgctaatagaatggctactgctttgactccacatacttgttctaaaccatcttcttttagatgtactggtgaagaatgtggtaaaggtaaagctggtgtttgtgataaatctggttgtcaaattaatccatacaagttgggtgataaaaagttttatggtccaggtggtactattgatacaaacaagagattcactgttttgactcaatttgttcacgaacatccagaagctggtattgatatttctagagctggtccattgaaagaaattagaagaaagtacattcaagatggtagagttattgaagatgttcatacttctaatgcttcattttctccattgaaaggtatggatcaaagattttgtgatacttatggttctgaagcttatactagattgggtggtattgttggtactggtcaatctatggctagaggtatggttttgattttctctatttggaactctgaaggtgattttatgaaatggttggatgctggtgatagaggtccatgtggtccaactgatggtgatccaaaaaagattaagcaagaaactccaaatgtttctgttacttactctaacattaaatggggtgaattgggtactgttttgggtcatgatgcttctccaggtgctaaaggtgatgaagctaaagctagattggctgctaattctggtggtgctactgctccagctgttactggtggttctgttttgggtttggctattgttttgttggctttggttcatttgttcttataa

SEQ ID NO: 15 - DNA, 1305 bp, Fusarium graminearum
atgttgttgcaagcttttttgtttttgttggctggttttgctgctaaaatttctgctcaaactccagataaaactcaagaaaagcatccaaagattgaaacttacagatgtactaaagctaaaggttgtaagaaagctacaaactacattgttgctgatgctgaattgcatggtatttctcaagctaatggtcaatcttgtggtaattggggtgaagctgctaattctactgcttgtccagatgaagctacttgtgctaagaattgtaaattgttcggtatgaatgaagctgcttataaagcaaaaggtatttctacttctggtaatgctttgagattggaaatgttgagaaatggtcaatcagtttctccaagagtttatttgttggaagaaaacaagaacaaatacgaaatgttgaaattgactggtgctgaattttcttttgatgttgaaactcaaaaattgccatgtggtatgaatggtgctttgtatttgtctgaaatgccagctgatggtggtaaatctacttctaagtactctaaagttggtgctgctcaaggtggtggttattgtgatgctcaatgttacgttactccattcattaatggtgttggtaacattaaaggtaaaggtgtttgttgtaacgaaatggatatttgggaagctaattctagagctactcatattgctccacatccatgttctgttccaggtttgtatggttgtacaggtgctgaatgtcaaaaagatggtatttgtgataaagctggttgtggttggaatcataatagaaatggtgttccagatttttatggtagaggtaagaattttaaggttgatactactagaaagttcactgttgtttcttcatttccagctgataaatctggtaaattgactgaaatgcatagacattacattcaagatggtaaggttattaagtctgctgttgttactttgccaggtccaccaaaagttactggtaacattattactgataactactgtaaagcttctcatgctgatgattacattagattgggtggtactgaagaaatgggtgatgctatgactagaggtatggttttggctatgtctgtttggtggtctgaaggtgattctatggaatggttggatggtcaaggtgctggtgctggtccatgtactaaagaagaaggtttgccaaagaatattgttaaggttgaaccaaatccagaagttactttctctaacattagaattggtgaaattggttctactcatgctgttaaaatgccaagagtttacggtgctcatagattataa

SEQ ID NO: 16 - DNA, 1425 bp, Hypocrea jecorina
atggtctccttcacctccctgctggccggcgttgccgctatctctggtgtcctagcagcccctgccgcagaagttgaacctgtcgcagttgagaaacgtgaggccgaagcagaagctcaacaaccaggaacatcaacaccagaagtccatccaaagttaacaacctataaatgtactaagagtggagggtgtgtagcgcaggacacaagtgtggtcttagactggaattatcgttggatgcatgatgccaattataattcctgtactgttaacggcggtgttaacactacgttatgccccgatgaagcgacttgtggtaagaattgttttattgaaggggttgactacgccgctagtggtgttacgacgagtgggtcatccttgacgatgaatcaatacatgccttcttctagtggtgggtattcctctgtgtctccaaggctgtatttattggattccgatggggaatatgttatgttaaaattaaatgggcaagaactgagttttgatgtggatctatctgcattaccttgtggagaaaatggtagtctttatttatcacaaatggacgaaaacggcggagccaatcagtacaatacagctggtgctaattatggttcaggctattgtgatgctcaatgtccagtgcagacttggaggaatggcaccttaaacacatcacatcaaggattttgctgtaacgaaatggacatattagaaggtaattcaagagctaatgcactaactccgcactcttgtactgcgaccgcatgtgattctgccggttgtggtttcaacccttatggttctggttataagagttactacggtccgggagacaccgtggatacgtcaaagaccttcactataatcactcagtttaacacagataacggatctccgagtggtaatttggtgagtattactaggaaatatcagcagaacggtgttgatattccgtccgcgcagccaggcggtgacactatatctagctgtccttccgccagtgcctatggcggacttgctacaatgggtaaggcattgtcctcaggtatggtcctagtattttctatttggaatgataattcacaatacatgaattggctggattctggtaatgcaggcccttgctcctctacagaaggtaacccaagcaatatactagctaataacccaaatactcatgttgtctttagtaatattagatggggcgatataggtagcactacgaacagtaccgcacctcctcctccacctgctagctccacgacattttccactactagaaggtccagcactaccagctcatcaccatcttgtactcaaacccattggggacagtgtggtggtataggttacagcggttgcaaaacttgcacatctggtactacatgccaatacagtaatgactattactcacaatgt

SEQ ID NO: 17 - DNA, 1260 bp, Hypocrea jecorina
atgaacaagtctgttgctccattgttgttggctgcttctattttgtatggtggtgctgttgctcaacaaactgtttggggtcaatgtggtggtattggttggtctggtccaactaattgtgctccaggttctgcttgttctactttgaatccatattatgctcaatgtattccaggtgctactactattactacttctactagaccaccatctggtccaacaactactactagagctacttctacatcttcttctactccaccaacttcatctggtgttagatttgctggtgttaacattgctggttttgattttggttgtactactgatggtacttgtgttacttctaaagtttacccaccattgaaaaatttcactggttctaacaattatccagatggtattggtcaaatgcaacattttgttaacgaagatggtatgactatttttagattgccagttggttggcaatatttggttaacaacaatttgggtggtaatttggattctacttctatttctaagtacgatcaattggttcaaggttgtttgtctttgggtgcttactgtattgttgatattcataattatgctagatggaatggtggtattattggtcaaggtggtccaacaaatgctcaatttacttctttgtggtcacaattggcttcaaaatatgcttctcaatctagagtttggtttggtattatgaatgaaccacatgatgttaacattaatacttgggctgctactgttcaagaagttgttactgctattagaaatgctggtgctacttctcaattcatttctttgccaggtaatgattggcaatctgctggtgcttttatttctgatggttctgctgctgctttgtctcaagttactaatccagatggttctactactaatttgatcttcgatgttcataagtacttggattctgataattctggtactcatgctgaatgtactacaaacaatattgatggtgctttttctccattggctacttggttgagacaaaacaatagacaagctattttgactgaaactggtggtggtaatgttcaatcttgtatccaagatatgtgccaacaaattcaatacttgaaccaaaattctgatgtttatttgggttacgttggttggggtgctggttcttttgattctacttacgttttaactgaaactccaacttcttctggtaattcttggactgatacttctttggtttcttcatgtttggctagaaagttataa

SEQ ID NO: 18 - DNA, 1170 bp, Chrysosporium lucknowense
atgaagtcctctattttggcttctgtttttgctactggtgctgttgctcaatctggtccatggcaacaatgtggtggtattggttggcaaggttctactgattgtgtttctggttatcattgtgtttaccaaaatgattggtactctcaatgtgttccaggtgctgcttctactactttgcaaacttctactacatctagaccaactgctacttctactgctccaccatcttctacaacttctccatctaaaggtaaattgaaatggttgggttctaatgaatctggtgctgaatttggtgaaggtaattatccaggtttgtggggtaaacatttcatttttccatctacctctgctattcaaactttgattaacgatggttacaacattttcagaatcgatttctctatggaaagattggttccaaatcaattgacttcttcatttgatgaaggttacttgagaaatttgaccgaagttgttaactttgttactaatgctggtaagtatgctgttttagatccacataattacggaaggtactacggtaatgttattactgataccaatgcttttagaactttttggactaatttggctaaacaattcgcttctaactctttggttattttcgataccaacaacgaatacaatactatggatcaaactttggttttgaatttgaaccaagctgctattgatggtattagagctgctggtgctacttctcaatacattttcgttgaaggtaatgcttggtctggtgcttggtcttggaatactactaatactaatatggctgctttgactgatccacaaaacaaaatcgtttacgaaatgcatcaatacttggattctgattcttctggtactcatgctgaatgtgtttcttctaatattggtgctcaaagagttgttggagctactcaatggttgagagctaatggtaaattgggtgttttgggtgaatttgccggtggtgctaatgctgtttgtcaacaagctgttactggtttgttggatcatttgcaagataattctgaagtttggttgggtgctttgtggtgggctgctggtccatggtggggtgattacatgtattcttttgaaccaccatctggtactggttacgttaattacaactccattttgaaaaagtacttgccataa

SEQ ID NO: 19 - DNA, 1254 bp, Polyporus arcularius
atgcattccttctctggtttgttggttgctgttgctttggctgtttctgttaaagctcaaactactttgtctccagtttggggtcaatgtggtggtactggttggactggtccaactgcttgtgctactggttctgtttgtactaaattgaacgatgctcattttcaatgtgttccaggtactgctactactgctccatcttctccatctactacttcatctgctccagctccaacttcttcttgtcaaattcctgctccatctgctggtaaattgagatttgctggtgttaatattgctggttttgattttggttgttctactgatggtacttgttctgcttctggtgcttggccaccattaactcaatattacggtaatgatggtgaaggtcaaatgcaacattttgttaaggatgatggttttaacgtttttagattgccagttggttggcaatatttgactgatggtgttttgggtggtactattgatgaagataacttcgaagaatatgatgctttggttcaagcttgtttgaatactggtgcttcttgcattattgatattcataactacgctagatggaatggtaagattattggtcaaggtggtccaactaatgaacaatttgctgaattgtggtcatctgttgctgcaaaatatgctaacaactccaagattattttcggtgttatgaatgaaccacatgatgttccagatattaacttgtgggctgaatctgttcaagctgctgttactgctattagaaaagctggtgctacttctcaaattatcttgttgccaggtaacaattggacttctgctgaaacttttatttctaatggttctggtgctgctttgatgaaagttactaatccagatggttctactactaatttggttttcgatgttcataagtacttggattctgataattctggtactcatgaagaatgtgttaccaacaatattgataatgcttgggctccattggctgaatggttgagatgtaatggtagacaagcttttaatactgaaactggtggtggtaatgttgcttcttgtcaacaatttatgtgtgaacaagttgcttttcaaaatgctaactccgatgtttttttgggttacgttggttgggctgctggtaatttctatcaaggttatgctttgggtgaagttccaacttattctaatggtcaatgggttgatacttctttggtttcttcttgtttggctccaaatgctagaaagtaa

SEQ ID NO: 20 - DNA, 1569 bp, Aspergillus kawachii
atgagaatttctaacttgattgttgctgcttctgctgctactatggtttctgctttgccatctagacaaatgaaaaagagggattctggttttaaatgggttggtacttctgaatctggtgctgaatttggttctgctttaccaggtactttgggtactgattatacttggccagaaacttctaaaattcaagttttgagaaacaagggtatgaacatttttagaataccattcttgatggaaagattaactccagatggtttgactggttcttttgcttctacttacttgtctgatttgaagtcaactgttgaatttgttactaattctggtgcttatgctgttttagatccacataattacggtagattcgatggttctattattgaatctacttctgattttaagacttggtggaaaaatgttgctactgaatttgctgataacgataaggttattttcgatacaaacaacgaatatcatgatatggaacaatctttggttttgaatttgaaccaagctgctattaatggtattagagctgctggtgctactactcaatacattttcgttgaaggtaatgcttatactggtgcttgggattggactacttacaatgatgatttgtctggtttaactgattctgaagataagataatatacgaaatgcatcaatacttggattctgattcttctggtacatctgaaacttgtgtttcttctactattggtaaagaaagaattgaaaaggctactgaatggttgaaaactaacaacaagcaaggtattattggtgaatttgcaggtggtgttaattctgtttgtgaagaggctgttgaaggaatgttggcttatatgtctgaaaattctgatgtttgggttggtgcttcttggtggtctgctggtccatggtggggtacttacatgtattctttggaaccaactgatggtactgcttattctacttatttgccaattttggaaaaatacttcccatctggtgatgcttcatcatcttcatctgcttcagcttcagttgcagccgctacttctgctgtttctactactactacagctgcatttgaacaaactactactccagctactcaagttgaaattgcttcttcttcatcttcatcatcagctgttgctgcttcacaaactactttgtctaaggttaagtctaaatctaaatctccatgtaaattgtcatctgctacttcatctgctgtttcatcagctgctgcagttactacacctgcagttgcagctacaactccagctgctgctccaacttcttcttctgttgcttttgctactacttctgtttacgttccaactactactgctgctgcaccatctcaagtttcatcttcagctgcagcttcatcttcaggtgttgttggtgtttctgatccacaaggtccatctgctactaattctgctggtgaagttaatcaatattaccaatgtggtggtattaattggactggtccaactgtttgtgcttctccatatacttgtaaggttcaaaacgattactactatcaatgtgttgctgaattataa

SEQ ID NO: 21 - DNA, 1263 bp, Heterodera schachtii
atgcattgggctgatgttgcttgttctagaccaccatggccaagagattctgttaaagctttgaagtgtaattggaacgctaatgttattagaggtgctatgggtgttgatgaaggtggttatttgtctgatgctaatactgcttacaatttgatggttgctgttattgaagctgctatttctaatggtatctacgttattgttgattggcatgctcataatgctcatccagatgaagctgttaaattctttactagaattgctcaagcttatggttcttacttgcatattttgtacgaagatttcaatgaaccattggatgtttcttggactgatgttttggttccataccataaaaaagttattgctgccattagagctattgataagaagaacgttattatcttgggtactccaaaatggtcacaagatgttgatgttgcttctcaaaatccaattaaggattaccaaaacttgatgtacactttgcatttttacgcttcatctcattttacatctgatttgggtgctaaattgaaaactgctgttaacaatggtttgccagtttttgttactgaatatggtacttgtgaagcttctggtaatggtaatttgaatactgattctatgtcatcttggtggactttgttggattctttgaaaatttcttacgctaattgggctatttctgataaatctgaagcttgttctgctttgtctccaggtactactgctgttaatgttggtgtttcttctagatggacttcttctggtaatatggttgcttcttactacaaaaaaaagtccactggtatttcttgttctggtagttcttcaggttcttcaagtggttcatctagtggttcttccggtacatcttctggttctagtggttcatctagtggtagttcttccggtagttctagtggtagttctggttcaagttctggttcctcctctggttctggttctgcatctatttctgttgttccatctaatacttggaatggtggtggtagagttaattttgaaattaagaacactggttctgttccattgtgtggtgttgttttttctgtttctttgccatctggtactactttgggtggttcttggaatatggaatctgctggttctggtcaatattctttaccatcttgggttagaattgaagctggtaaatcttctaaagatgctggtttgacttttaatggtaaagataagccaactgctaaaattgttaccaccaagaagtgcttataa

SEQ ID NO: 22 - DNA, 1419 bp, Orpinomyces sp.
atgaagttcttgaactctttgtctttgttgggtttggttattgctggttgtgaagctatgagaaacatttcttctaaagaattggttaaagaattgactattggttggtctttgggtaatactttggatgcttcttgtgttgaaactttgaactactctaaagatcaaactgcttctgaaacttgttggggtaatgttaaaactactcaagaattgtactacaaattgtctgatttgggtttcaatactttcagaataccaactacttggtctggtcattttggtgatgctccagattacaaaatttctgatgtttggatgaaaagagttcacgaagttgttgattatgctttgaatactggtggttacgctattttgaacattcatcatgaaacttggaattacgcttttcaaaagaatttggaatctgctaaaaagattttggttgctatttggaaacaaattgctgctgaatttggtgattacgatgaacatttgatttttgaaggtatgaatgaaccaagaaaagttggtgatccagctgaatggactggtggtgatcaagaaggttggaattttgttaatgaaatgaacgctttgttcgttaaaactattagagctactggtggtaacaatgctaatagacatttgatgattccaacttatgctgcttctgttaatgatggttctattaacaattttaagtacccaaatggtgatgataaagttattgtttctttgcattcttactctccatacaattttgctttgaacaatggtccaggtgctatttctaatttctacgatggtaacgaaattgattgggttatgaacactattaactcttcattcatttctaagggtattccagttattattggtgaatttgttgctatgaacagagataatgaagatgatagagaaagatggcaagaatactacattaaaaaggctactgctttgggtattccatgtgttatttgggataatggttattttgaaggtgaaggtgaaagatttggtattattgatagaaagtctttgaacgttattttcccaaagttgattaatggtttgatgaaaggtttgggtgatgaaaaaccaaaaactactattagaagaactactactactacagttcaagttcaaccaactattaacaacgaatgtttctctactagattgggttattcttgttgtaatggtttcgatgttttgtacactgataatgatggtcaatggggtgttgaaaatggtaattggtgtggtattaaatcttcttgtggtaacaatcaaagacaatgttggtctgaaagattaggttatccatgttgtcaatacactactaatgctgaatatacagacaacgacggtagatggggtgtagaaaacggtaactggtgcggaatatacttgtaa

SEQ ID NO: 23 - DNA, 1220 bp, Irpex lacteus
ttaattaaaatgaagtctttgttgttgtctgctgctgctactttggctttatctactccagctttttctgtttctgtttggggtcaatgtggtggtattggttttactggttctactacttgtgatgctggtacttcttgtgttcatttgaacgattactactttcaatgtcaaccaggtgctgctacttctactgttcaaccaactactactgcttcttctacttcttctgctgcagctccatcttcttcaggtaatgctgtttgttctggtactagaaacaagtttaagttcttcggtgttaatgaatctggtgctgaatttggtaacaatgttattccaggtactttgggtactgattatacttggccatctccatcttctattgattttttcgttggtaagggttttaatactttcagagttccatttttgatggaaagattgtctccacctgctactggtttgactggtccatttgattctacttatttgcaaggtttgaaaactattgtttcttacattactggtaaaggtggttatgctttggttgatccacataactttatgatttacaacggtgctactatttctgatactaatgcttttcaaacttggtggcaaaatttggctgctcaatttaagactgattctcatgttgttttcgatgttatgaatgaaccacatgatattccagctcaaactgtttttaacttgaaccaagctgctattaatagaattagagcttctggtgctacttctcaatctattttggttgaaggtacttcttatactggtgcttggacttggactactacttctggtaattctcaagtttttggtgctattcatgatccaaacaacaatgttgctattgaaatgcatcaatacttggattctgatggttctggtacttctccaacttgtgtttctccaactattggtgctgaaagattgcaagctgctactcaatggttgcaacaaaacaatttgaaaggtttcttgggtgaaattggtgctggttctaatgctgattgtatttctgctgttcaaggtgctttgtgtgaaatgcaacaatctgatgtttggttgggtgctttgtggtgggctgctggtccatggtggggtgattattttcaatctattgaaccaccatctggtgttgctgtttcttctattttgccacaagctttggaaccatttttgttataaggcgcgcc

SEQ ID NO: 24 - DNA, 1155 bp, Chaetomium globosum
atgaagtcctctattttggctggtgtttttgctactggtgctgttgctcaatctggtgcttggggtcaatgtggtggtaatggttggcaaggtgctactacttgtgtttctggttatcattgtgcttatcaaaatgattggtactctcaatgtttgccaggtggtgcttctactactttgagaacttctactactacttcttctgctccagctgctacttctacatctccagctaaaggtaaattcaagtggtttggtattaatcaatcttgtgccgaatttggtactccaacttatccaggtatttggggtaaacattttacttttccatctacctcttctattcaaaccttgattaacgatggttacaatacttttagagttgctttctctatggaaagattggttccagatcaattgacttctacaacttttgatgctggttacttgagaaatttgactgaaaccgttgatttcattactaatgctggtgcttatgctgttttagatccacataattacggaaggtactacggtgatattatcactgatacaaacgcttttaagactttttggactaatttggctactaagttcgtttctaactctagagttgtttttgataccaacaacgaatacaatactatggatcaaactttggttttgaatttgaaccaagctgctattaatggtattagagctgctggtgctactcaacatatttttgttgaaggtaatgcttggtctggtgcatggtcttggaatactactaataccaatatggttgctttgactgatccacaaggtaaattggtttacgaaatgcatcaatacttggatactgattcttctggtacttctccagattgtgtttctgctgaaattggtgttcaaagagttgttggagctactaattggttgagagctaatggtaagattggtattattggtgaatatgccggtggcccaaatactgtttgtcaaactgctgttactaatttgttggaacatttgaaggctaattctgatgtatggcagggtgcattgtggtgggccggtggtccttggtggggtgattacatgtattcttttgaaccaccatctggtactggttatactaattacaactccatcttgaaaaaatacgctccataa

SEQ ID NO: 25 - DNA, 1251 bp, Aspergillus niger
atgagaatctccaacttgattgttgctgcttctgctgcatctatggtttctgctttgccatctagacaaatgaaaaagagggattctggttttaaatgggttggtacttctgaatctggtgctgaatttggttctgctttaccaggtactttgggtactgattatacttggccagaaacttctaaaattcaagtcttgagaaacaagggtatgaacatttttagaatcccattcttgatggaaagattaactccagatggtttgacttcttcttttgcttctacttacttgtctgatttgaagtctactgttgaatttgttactaattctggtgcttatgctgttttagatccacataattacggtagattcgatggttctattattacttctacctctgattttaagacttggtggaaaaatgttgctactgaatttgctgataacgataaggttattttcgataccaacaacgaatatcatgatatggaacaatctttggttttggatttgaatcaagctgctattaatggtattagagctgctggtgctactactcaatacattttcgttgaaggtaatgcttatactggtgcttgggattggactacttacaatgataatttgtctggtttgactgattctgaagataagatcatttacgaaatgcatcaatacttggattctgattcttctggtacatctgaaacttgtgtttcttctactattggtcaagaaagattggaaaaagctactgaatggttgaaaactaacaacaagcaaggtattgttggtgaatttgccggtggtgttaattctgtttgtgaagaagctgttgaaggcatgttggcttatatgtctgaaaattccgatgtttgggttggtgcttcttggtggtctgctggtccatggtggggtacttacatgtattctttggaaccaactgatggtactgcttattctacttatttgccaatcttggaaaaatactttccatctggtgatgcttcagcttcttcttctgcatctgtttctgttgctgctgctacttctactgcttctactactacagctgcttttgaacaaactactactccagctactcaaggtccatctgctactaattctgctggtgaagttaatcaatattaccaatgcggtggtattaattggactggtccaactgtttgtgcttctccatatacttgtaaggttcaaaacgattactattaccaatgtgttgctgagtaa

SEQ ID NO: 26 - DNA, 1236 bp, Penicillium decumbens
atgagatcctcccataaaagaaatttggctgctttgttgtctatttctggtgctgctgttgctcaacaaactgcttggggtcaatgtggtggtcaaggttggtctggtgctacttcttgtgtttctggttatacttgttcttacactaatgattggtactctcaatgtgttccaggttcttctggtggtggtggttctaatccaactactactactacaatgattagaactactacaactgcttcttcttctggtccaactggtggtgccggtggtggtaaagttagatttgctggtgttaatattgctggttttgatttcggtgttgttatttcaggtactcaagatatgacacaaattgttgatgaatctgttgatggtgttaatcaaatgagacacttcgttaatgatgatggtttcaacatttttagattgccatctggttggcaatttttggttaacaacaatttgggtggttctttggattctaacaatttcgctaagtacgataaattggttcaaggttgtttgtctttgggtgcttattgtattgttgatgttcataattacgctagatggaatggtggtgttattggtcaaggtggtccaactgatgatcaatttacttctttgtggacacaattggctactcattacaaatctgaatccaagattattttcggtgttatgaatgaaccacatgatttggatattaacagatgggctactactgttcaaaaagctgttactgctattagaaaagctggtgctacatctcaaatgattttgttgccaggtactgattttacttctgctgctaattttgttgaaaatggttctggtgcagctttgtctgctgttactaatttggatggttctactaccaatttgattttcgatgttcacaaatacttggattctgataattctggtactcatgctgaatgtgttacaaacaatgctgatgcttttaattctttggctcaatggttgagaactaacaaaagacaagcaatgttgactgaaactggtggtggtaatgttcaatcttgtggtacttatatgtgtcaacaattggatgttttgaaccaaaattccgatgtttatttgggttggacttcttggtctgccggtggttttcaagtttcttggaattacgttttgggtgaagttccaactaacaatgttgatacctacttggttaagcaatgttttgttccaaagtggaagaattaa

SEQ ID NO: 27 - DNA, 705 bp, Trichoderma reesei
atgaagttcttgcaagttttgccagctttgattccagctgctttggctcaaacttcttgtgatcaatgggctacttttactggtaatggttacactgtttctaacaatttgtggggtgcttctgctggttctggttttggttgtgttactgctgtttctttgtctggtggtgcttcttggcatgctgattggcaatggtctggtggtcaaaacaatgttaagtcttaccaaaactctcaaattgctattccacaaaagagaaccgttaactctatttcttctatgccaactactgcttcttggtcttattctggttctaatattagagctaacgttgcttatgatttgtttactgctgctaatccaaatcatgttacttattccggtgattacgaattgatgatttggttaggtaagtatggtgatattggtccaattggttcttctcaaggtactgttaatgttggtggtcaatcttggactttgtattatggttacaatggtgctatgcaagtttattctttcgttgctcaaactaacactactaattactctggtgatgttaaaaacttcttcaactacttgagagataacaaaggttacaatgctgctggtcaatacgttttgtcttaccaatttggtactgaaccatttactggttctggtactttgaatgttgcttcttggactgcttctattaactaa

SEQ ID NO: 28 - DNA, 714 bp, Phanerochaete chrysosporium
atgttcaaggctttgttggctgttggttttgctattgctttgacttttgcttctgctgctcaaactattactggtcaatacgattgtattccagctggtgcttatactttgtgtcaaaatttgtggggtgaatatgctggtgttggttctcaaaattctactttgatttctactaatggtaatgctgttacttggcaaactaattggacttgggctaacaatccaaatactgttaaatcttgtgcttctcattcttttccaattgcttcatctgctccaactgcttggaattggacttacgttactgaatctcaaggtattagagctgatgtttcttacgatatttggtttggtaaagctcaatctggtaatccagctacttctgcttcttcttacgaaattatgatttggttgtctggtttgggtggtattcaaccagttggtcatcaaattttgtccggtttgaatattgctggtcatacttggaatttgtggtctggtccaaattctaattggcaagttttctctttcgttatttcttctggtgaagttagaaatttttccgctgacttgaatgaatttttccaatacttgattcaatctcaaggtgttgcttctactcaatatttgcaagctattcaagttggtactgaaccatttgttggttctgcttcattgttgactgaatcttttgctgttgctgttaacgtttaa

SEQ ID NO: 29 - DNA, 705 bp, Stachybotrys echinata
atgaaaaccttcgctattttgggtgcttttttttcttctgctttggctcaaactttgtgtgatcaatatgctacttactctaatggcagatacactgttaacaacaatttgtggggtatgagttctggttctggttctcaatgtacttacgttgattctatttctaattctggtgttgcttggcatactacttggacttggtctggtggtgataatcaagttaaatcttacgctaactctcaagtttctttgactaagaagttggtttctcaaatttcttctattccaactactgttcaatggtcttacgataacactaatactagagctgatgttgcttatgatttgtttactgctgctgatccaaatcatgttacttattccggtgattacgaattgatgatttggttggcaagatatggtaatgttcaaccaattggttctcaaattgcctctgttaatattggtggtcataattgggaattgtggtatggtggttctactcaaaaaacttactctttcgtttctgctactccaattacttctttttctggtaacgttatggatttttggaattacttgactagaaatcatggttatccagcttcatctcaatacttgatcaacatgcaatttggtactgaaccatttactggtggtccagctactttgagagtttctcaatggactgcttctgttaactaa

SEQ ID NO: 30 - DNA, 705 bp, Neosartorya fischeri
atgaaaaccttcgctattttgggtgcttttttttcttctgctttggctcaaactttgtgtgatcaatatgctacttactctaatggcagatacactgttaacaacaatttgtggggtaaatcttctggttctggttctcaatgtacttacgttgattctatttctaattctggtgttgcttggcatactacttggacttggtctggtggtgataatcaagttaaatcttacgctaactctcaagtttctttgactaagaagttggtttctcaaatttcttctattccaactactgttcaatggtcttacgataacactaatactagagctgatgttgcttatgatttgtttactgctgctgatattaatcatgttacctactctggtgattatgaattgatgatttggttggcaagatatggttctgttcaaccaattggttctcaaattgattctgttaacattggtggtcatacttgggaattgtggtatggtggttctactcaaaaaacttactctttcgtttctgctactccaattacttctttttctggtgatgttatggatttttgggattacttgacttctagacatggttatccagcttcatctcaatacttgatcaacatgcaatttggtactgaaccatttactggtggtccagctactttgagagtttctcaatggactgcttctgttaactaa

SEQ ID NO: 31 - DNA, 745 bp, Chaetomium brasiliense
aatgaagttgaccttggttttgtttgtttcttctttggctgctgctactccattgggttggagagaaagaaggcaacaagtttctttgtgtggtcaatcttcttcttggtctggtaatggttatcaattgaacaacaatttatggggtcaatctagagctacttctggttctcaatgtacttatttggattcttcttctaactctggtattcattggcatactacttggacttgggaaggtggtgaaggtgaagttaaatcttatgcttactctggtagacaagtttctactggtttgactattgcttctattgattctatgcaaacttctgtttcttgggaatacaacactactgatattcaagctaatgttgcttacgatattttcactgctgaagatccagatcatgaacattcttcaggtgattacgaagttatgatttggttggcaagatataacaatgtttctccaattggttcttctgttgctactgctactgttggtggtgatacttgggatttgtttgctggtgctaatggtgatatggaagtttattctttcgttgctgaaaatactatgaactctttctctggtgatgttaaagatttcttcgactacttggaacaaaatgttggttttccagttgatgatcaatacttgttggtttttgaattgggttctgaagcttttactggtggtccagctactttgtctgtttctcaattctctgctaacattgcttaa

SEQ ID NO: 32 - DNA, 1053 bp, Chaetomium globosum
atgtctaaggcttctgctttgttggctactttgactggtgctgctttggttgctgctcatggtcatgtttctcatattattgttaacggtgtttactacgaaaattacgatccaactactcattggtatcaaccaaatccaccaactgttattggttggaaagctgctcaacaagataatggttttgttgaaccaaacaattttggtacttctgatatcatttgtcataagtctggttctccaggtggtggtcatgctactgttgctgctggtgataagatttctattgtttgggatccagaatggccagaatctcatattggtccagttattgattatttggctgcttgtaatggtgattgtgaaactgttgataaagcttctttgagattctttaagattgatggtgctggttatgataaaactgctggtagatgggctgctgatactttgagagctaatggtaattcttggttggttcaaattccagctgatttgaaagctggtaattacgttttgagacatgaaattattgctttgcatggtgcttcatctccaaatggtgctcaagcttatccacaatgtattaacttgagagttactggttctggtactaatgctccatctggtgttgctggtacttctttgtatagagcttctgatgctggtattttgtttaatccatacgttgcttctccaaattatccagttccaggtccagctttgattgctggtgctgcatcttctgttgctcaatctaaatctgttgctactgctacagcttctgctactttgccaggtaacaacaatggtggtggtccaaatccacaaccaactactgctactactactgctaatccaggtgtttctactactttgagaacttctacttctacttcaacatctgctcaagttactccaccaccaactggtggtaatgctcaaactaaatatggtcaatgtggtggttctggttggactggtccaactgcttgtgctgctggttcttcttgttctgttttgaatgattggtatgctcaatgtgtttaatga

SEQ ID NO: 33 - DNA, 1125 bp, Aspergillus fumigatus
atgtctgttccaaaaattgctgctgctttgttatcttctgctgctttggttgctggtcatggttttgttactggtgctgttgttgatggtaaatactatactggttacttggttaatcaatacccatatatgtcatctccaccagattctattggttggtctgaaactgctactgatttgggttttgttgatggttctggttattcttctggtgatatcatttgtcataaggatgctaaaaatggtgctatttctgctgaaattaaagctggtggtaaggttgaatttcaatggactgaatggccagaatctcatcatggtccagttattacttatatggctaactgtaatggtgattgtgcttctgttgataaaactactttggaattcttcaagattgatgaatctggtttgatttctgattctaatgttccaggtacttgggcttctgataatttgattgctaacaacaattcttggactgttactgttccatcttctattgctgctggtaattatgttatgagacatgaaattattgctttgcattctgctggtaatcaaaatggtgctcaaaattacccacaatgtattaacttgaaagttactggtggtggttctgataaaccagctggtactttgggtactgctttgtacaaaaatactgatgctggtattttggttaacatttaccaatctttgtcatcttatgaaattccaggtccagctttgtattctggtgcttcttctggttcttctaacaatggtggttctgcttcttcatctgctactgctccatctgctactattactcaaccatctactgctgttccaacttcttctgctacagcttatcaaccatcaactactactgaagctgttactgttacttctattccagctcaacaatcttatgttcaagcaccaactgctactccatcttctacagctggttcttcaggttctggttcaggttcttcttcttctggtactttgccatcttcttctaatttgactgaatacttcaattctttgtctgctgaagaatttttgaaggttttgaagcaaactttttcttggttggttactgaaaaagttcatgctagagatttgtctgcataatga

SEQ ID NO: 34 - DNA, 963 bp, Humicola insolens
atgagaccattttctttggttgctttggctactgctgtttctggtcatgctatttttcaaagagtttctgttaacggcgttgatcaaggtcaattgaaaggtgttagagcaccatcttctaattacccaattgaaaacgttaatcatccagattttgcttgtaacactaacattagacatagagatggtactgttattaagattccagctggtgctactgttggtgcttggtggcaacatgaaattggtggtccatcttttccaggtgatccagataatccaattgctgcttctcataaaggtccaattcaagtttatttggctaaggttgataatgctgctactgcttctccaaatggtttgagatggtttaagattgctgaaaaaggtttgtctggtggtgtttgggctgttgatgaaatgattagaaacaatggttggcattactttactatgccacaatgtattgctccaggtcattatttgatgagagttgaattgttggctttgcattctgcttcatttccaggtggtgctcaattttacatggaatgtgctcaaattgaagttactggttctggtaatttttctccatctgaaactgtttcttttcctggtgcttatccagctaatcatccaggtattgttgtttcaatttacgatgctcaaggtaatgctaacaatggtggtagagaatatcaaattccaggtccaagaccaattacttgttctggtggtggttctaacaacggtggtggcaacaacaatggaggcggaaacaacaacggcggtggaggtaacaacaatggcggtggcaacaacaatggcggaggtaatactggtggtggtagtgctccattgtggggtcaatgtggtggtaatggttattctggtccaactacttgtgctgaaggtacttgtaaaaagcaaaacgattggtattctcaatgtactccataatga

SEQ ID NO: 35 - DNA, 1152 bp, Neosartorya fischeri
atgtctcaaactaagtctttgtctttgttggctgttttgttgtctgctactagagttgctgctcatggtcatgttactaatgttgttgttaacggtgtttcttatgctggtttcgatattaactcttacccatatatgtctgatccaccaaaagttgctgcttggactactccaaatactggtaatggttttattgctccatctgcttataattctccagatatcatttgtcatcaaaacgctactaatgctcaagcttacattgaaattgctgctggtgatagaattcaattgcaatggactgcttggccagaatctcatcatggtccagttattgatatgttggcttcttgtggtgaatcttgtactactgttgataagacttctttgaagttctttaagattgatggtgttggtttggttgataattctgctgttccaggtacttggggtgatgatcaattgattgctaattctaactcttggatggttgaaattccaaaatctattgctccaggtaattatgttttgagacatgaattgattgctttgcatggtgcttttgaagaaggtggagcacaaaattatccacaatgtttcaacttgaaagttactggttctggtactgattctccagctggtactttgggtactgaattgtatactgaatctgatccaggtttgttggttgatatctacaagtctattgcttcttatgctgttcctggtccagctatgtattctggtgctgtttctattactcaaactacttctgctattacttctactggtactgctactgttggttctggtgcagattctactccagttccatcatctgctgcttcatctaaatattctactattgctgttcaagttccaactactaaagctcaatatacacctgttccttcatcttctccatctacttttgttacttctcctgctccttcaacaccagtaccttcatcatcttcagttccagttacttcttctactgctgctccacaaccaactccagctccaggtggtactcaaactgcttatggtcaatgtggtggtagaaattggactggtccaactgcttgtgcttctggttctacttgtaaaacttggaatccatactattctcaatgtgttccaaattaatga

SEQ ID NO: 36 - DNA, 984 bp, Thielavia terrestris
atgaagtctttcactattgctgctttggctgctttatgggctcaagaagctgctgctcacgctacttttcaagatttgtggattgatggtgttgattatggttctcaatgtgttagattgccagcttctaattctccagttactaatgttgcttctgatgatattagatgtaacgttggtacttctagaccaactgttaaatgtccagttaaagctggttctactgttactattgaaatgcatcaacaaccaggtgatagatcttgtgctaatgaagctattggtggtgatcattatggtccagttatggtttacatgtctaaagttgatgatgctgttactgctgatggttcttctggttggtttaaggtttttcaagattcttgggctaaaaatccatctggttctacaggtgatgatgattattggggtactaaggatttgaattcttgttgtggtaagatgaatgttaagattccagaagatattgaaccaggcgattatttgttgagagctgaagttattgctttgcatgttgctgcttcatctggtggtgctcaattttacatgtcttgttaccaattgactgttactggttctggttctgctactccatctactgttaattttccaggtgcttattctgcttctgatccaggtattttgattaacattcatgctccaatgtctacttatgttgttccaggtccaactgtttatgctggtggttctactaaatctgctggttcttcttgttctggttgtgaagctacttgtactgttggttctggtccatctgctactttgactcaaccaacttctactgctactgctacttctgctccaggtggtggtggttctggttgtactgctgctaaatatcaacaatgtggtggtactggttatacaggttgtactacttgtgcttctggttcaacttgttctgctgtttctccaccatattattctcaatgtttgtaatga

SEQ ID NO: 37 - DNA, 681 bp, Chrysosporium lucknowense
atgcatttgtctgctactactggttttttggctttgccagctttggctttggctcaattgtctggttctggtcaaactactagatattgggattgttgtaaaccatcttgtgcttggccaggtaaaggtccatcttctccagttcaagcttgtgataagaatgataacccattgaatgatggtggttctactagatctggttgtgatgctggtggttctgcttatatgtgttcttctcaatctccatgggctgtttctgatgaattgtcttatggttgggctgctgttaaattggctggttcttctgaatcacaatggtgttgtgcttgttatgaattgacttttacttctggtccagttgctggtaaaaagatgattgttcaagctactaatactggtggtgatttgggtgataatcatttcgatttggctattccaggtggtggtgttggtattttcaatgcttgtactgatcaatatggtgctccaccaaatggttggggtgatagatatggtggtattcattctaaagaagaatgcgaatcttttccagaagctttgaaaccaggttgtaattggagatttgattggtttcaaaatgctgataatccatctgttacttttcaagaagttgcttgtccatctgaattgacttctaaatctggttgttctagataatga

SEQ ID NO: 38 - DNA, 930 bp, Chaetomium globosum
atgagatctactccaattttgagaactgctttggctgctgctttgccattggttgcttatgctgctgatggtaaatctactagatattgggattgttgtaaaccatcttgttcttggccaggtaaagctttggttaatcaaccagtttatgcttgttctgctaactttcaaagaattactgattctaatgctaaatctggttgtgatggtggttctgctttttcttgtgctgatcaaactccatgggctttgaatgatgattttgcttatggttttgctgctacttctttggctggtggttctgaagcttcttggtgttgttcttgttacgaattgacttttacttctggtccagttgctggtaaaaagatggttgttcaatctacttctactggtggtgatttgggttctaatcatttcgatttgaatattccaggtggtggtgttggtatttttgatggttgttctccacaatttggtggtttgggtggtcaaagatatggtggtgtttcttctagatctgaatgtgatgcttttccagaagctttgaaaccaggttgttattggagatttgattggtttaagaatgctgataatccaaatttcactttcagacaagttcaatctttgccaaaaccatcttcttcatcttctccagttgctgttccaaaaccaacttctactccaggttcagttccaaaacctacatcaacacctggttctgctccagaacctgctactccaacttctgctgttccatctgttaaaacttcagcttctgcttctccatctaaatcttcatctccagtttcttgtgttactgaaaaatatggtcaatgtggtggtaatggttttactggttgtaaaacttgtacttgtggtactacttgtaaaaagcaaaacgattggtattctcaatgtttgtaatga

SEQ ID NO: 39 - DNA, 951 bp, Acremonium thermophilum
atgagatcttctccatttttgagagctgctttggctgctgctttgccattgtctgctcatgctttggatggtaaatctactagatattgggattgttgtaaaccatcttgtggttgggctggtaaagcttctgttaatcaaccagttttttcttgttctgctgattggcaaagaatttctgattttaacgctaaatctggttgtgatggtggttctgcttattcttgtgctgatcaaactccatgggctgttaatgataatttctcttacggttttgctgctactgctattgctggtggttctgaatcttcttggtgttgtgcttgttatgctttgacttttaattctggtccagttgctggtaaaactatggttgttcaatctacttctactggtggtgatttgggttctaatcaattcgatttggctattccaggtggtggtgttggtattttcaatggttgtgcttctcaatttggtggtttgccaggtgctcaatatggtggtatttctgatagatctcaatgttcttcttttcctgctcctttgcaaccaggttgccagtggagatttgattggtttcaaaatgctgataatccaacttttactttccaaagggttcaatgtccatctgaattgacttctagaactggttgtaaaagagatgacgacgcttcttacccagtttttaatccaccatctgttccaggtttggatggttctaatccaggtaatccaactactactgttgttccaccagcttctacttctacatctagaccaacatcttctacttcatctccagtttctactccaactggtcaaccaggtggttgtactactcaaaaatggggtcaatgtggtggtattggttatactggttgtactaattgtgttgctggtactacttgtactcaattgaatccatggtattctcaatgtttgtaatga

SEQ ID NO: 40 - DNA, 921 bp, Humicola insolens
atgagatcttctccattgttgccatctgctgttgttgctgctttgccagttttggctttggctgctgatggtagatctactagatattgggattgttgtaaaccatcttgtggttgggctaaaaaagctcctgttaatcaaccagttttttcttgtaatgctaacttccaaagaattactgattttgatgctaaatctggttgtgaaccaggtggtgttgcttattcttgtgctgatcaaactccatgggctgttaatgatgattttgctttgggttttgctgctacttctattgctggttctaatgaagctggttggtgttgtgcttgttatgaattgacttttacttctggtccagttgctggtaaaaagatggttgttcaatctacttctactggtggtgatttgggttctaatcatttcgatttgaatattccaggtggtggtgttggtatttttgatggttgtactccacaatttggtggtttgccaggtcaaagatatggtggtatttcttctagaaacgaatgtgatagatttccagatgctttgaaaccaggttgttattggagatttgattggtttaagaatgctgataatccatctttttcattcagacaagttcaatgtccagctgaattggttgctagaactggttgtagaagaaatgatgatggtaattttccagctgttcaaattccatcttcttctacatcttctccagttaaccaacctacttctacttctacaacttctacttcaactacatcttcaccaccagttcaaccaactactccatctggttgtactgctgaaagatgggctcaatgtggtggtaatggttggtctggttgtacaacttgtgttgctggttcaacttgtactaagattaacgattggtatcatcaatgtttgtaatga

SEQ ID NO: 41 - DNA, 903 bp, Thielavia terrestris
atgagatctactccagttttgagaactactttggctgctgctttgccattggttgcttcagctgcttctggttctggtcaatctactagatattgggattgttgtaaaccatcttgtgcttggccaggtaaagctgctgtttctcaaccagtttatgcttgtgatgctaattttcaaagattgtctgatttcaatgttcaatctggttgtaatggtggatctgcttattcttgtgctgatcaaactccatgggctgttaatgataatttggcttatggttttgctgctacttctattgctggtggttctgaatcttcttggtgttgtgcttgttatgctttgacttttacttctggtccagttgctggtaaaactatggttgttcaatctacttctactggtggtgatttgggttctaatcaattcgatattgctatgccaggtggtggtgttggtattttcaatggttgttcttctcaatttggtggtttgccaggtgctcaatatggtggtatttcttctagagatcaatgtgattcttttccagctcctttgaaaccaggttgtcagtggagatttgattggtttcaaaatgctgataatccaacttttactttccaacaagttcaatgtccagctgaaattgttgctagatcaggttgtaaaagaaacgatgattcttcttttcctgtttttactccaccatcaggtggtaatggtggtactggtactccaacttctactgctccaggttcaggtcaaacttcacctggtggtggttctggttgtacatctcaaaaatgggctcaatgcggtggtattggtttttctggttgtactacttgtgtttctggtactacttgtcaaaaattgaacgattactactctcaatgtttgtaatga

SEQ ID NO: 42 - DNA, 1191 bp, Chrysosporium lucknowense
atgaagttcgttcaatctgctactttggcttttgctgctactgctttggctgctccatctagaactactccacaaaaaccaagacaagcttctgctggttgtgcttctgctgttactttggatgcttctactaatgttttccaacaatacactttgcatccaaacaatttttacagagctgaagttgaagctgctgctgaagctatttctgattctgctttagctgaaaaagctagaaaagttgctgatgttggtacttttttgtggttggatactattgaaaacattggtagattggaaccagctttggaagatgttccatgtgaaaatattgttggtttggttatctatgatttgccaggtagagattgtgctgctaaagcttctaatggtgaattgaaagttggtgaattggatagatacaagactgaatacattgataagattgctgaaattttgaaggctcattctaatactgctttcgctttggttattgaaccagattctttgccaaatttggttacaaattctgatttgcaaacttgtcaacaatctgcttctggttatagagaaggtgttgcttatgctttgaagcaattgaatttgccaaatgttgttatgtatattgatgctggtcatggtggttggttgggttgggatgctaatttgaaaccaggtgctcaagaattggcttctgtttacaaatctgctggttctccatctcaagttagaggtatttctacaaatgttgctggttggaatgcttgggatcaagaaccaggtgaattttctgatgcttcagatgctcaatataacaagtgtcaaaacgaaaagatttacattaatactttcggtgctgaattgaaatctgcaggtatgccaaatcatgctattattgatactggtagaaatggtgttactggtttgagagatgaatggggtgattggtgtaatgttaatggtgctggttttggtgttagaccaactgctaatactggtgatgaattggctgatgcttttgtttgggttaaaccaggtggtgaatctgatggtacttctgattcttctgctgctagatatgattctttttgtggtaaaccagatgcttttaaaccatctccagaagctggtacttggaatcaagcttactttgaaatgttgttgaagaatgctaatccatctttttaatga

SEQ ID NO: 43 - DNA, 1155 bp, Magnaporthe grisea
atgttgttctcttctgttttgttgggtttgactgctactgctggtgtttctgctatgccaagaaatagaggttcttcaccaagacatattagaagacaagaaggtgctaatccatttgaaggtaagaagttgtttgctaatccagaatgggctgaaaaagctgaaccagctttggctcattatgaatctattggtgattctgctaatgctgctagagttagaaaagttcaacaaactggtacttttgtttgggtttctaacattgcttctttgccaaatattgatgctgctattgaaggtgctagagctgctaaagaagctactggcgaagatcaaattgttggtttggttcattacaatttgccagatagagattgttctgctggtgaatcagctggtgaattggattctactaaagatggtttgagattgtacaaagaaacttacgttgctccatttgctgaaaaattggctgctgctactgatttgacttttgctgttgttttggaaccagattctttggctaatttggttactaatatgggtgttgaattttgtgctagagcagctccagtttatgaagaaggtattgctcacgctattaagtctttgcaattcgatcatgttcatttgtatttggatgctgctcatggtggttggttgggttgggatgataatttggctccaactgctaaagaatttgctaaagttgttgctatggctggtggtaattctactgttagaggtgttgttactaatgtttctaactacaacccattcattatgccagaaccattggaaccatatactgaatggtctaactcttatgatgaatctcattacgctttgtctttggctccacatttggaagctgaaggtttgccatctagatttttgattgatcaaggtagagttcatttgccaggtgctagagaagaatggggtgaatggtgtaatgttgaacctgctggttttggtattgctccaggtactccaactgaaaatccacatgttgattctattgtttgggttaaaccaggtggtgaatctgatggtgaatgtggtatggaaggtgctactagagctggtgcttggtttgaagaatacttcagaatgttggttgaaaatgctcatccatctttggattcttaatga

SEQ ID NO: 44 - DNA, 1269 bp, Chaetomium globosum
atgagatctttcactttgttggctggtttgttggctactgcttctgctttgccagctattgaacctagacaatctggtaatccattttctggtagaactttgttggttaatccatcttattctgaatctttggaacaaactagacaagctttggctaatgctggtgatcaaacttctgctggtaaagttaagtttgttcaagataaggttggtacttttgtttggatttctaacattgctttgttggcagatattgataaggctattactaatgctagagctgctaaagctaaaggtgaaaatccagttattggtttggttttgtacaatattccagatagagattgttctgctggtgaatcttctggtgaattgtcttttgctcaaaatggtttggctagatacaaatctgaatacgttactccatttgctcaaaaattgaaagctgcttctgatttgcaatttgctgttgttttggaaccagatgctatgggtaatatggttactggtactactgctttttgtcaaaatgctagaggtccacaacaagatggtattgcttatgctattcaacaattgcaagcttctaatgttgctttgtatttggatgttgctaatggtggttggttgggttggccagataatttggaattgactgctgatgttgttgctactattttgcaaaaagctggtggtaacaatagaattagaggttatgcttctaacgtttctaattacaacccatacaaatctgctaatccaccagcttatactgaaggttctccatctccagatgaatctagatatgctgataatttggctgctgcttttggtcaaagaggtttgccaactaagttcattattgatcaaggtagagttgctttggatggtgctagaaaagaatggggtgaatggtgtaatgtttatccatctggttttggtcaaccatttactactaatactggtaacaacaacgttgatgctattgtttggattaaaccaggtggtgaatctgatggtcaatgtggtatgccaggtgctccaagagctggtgcttggtttgatgcttttgctcaacaattggctaaaaatgctcatccagatattactgctggtggtggtaacaacggtggaggtggcaatcctggcggtggtaattgtgctgctagatgggctcaatgtggtggtcaaggttttactggtccaacttgttgttctgaaggtacttgtactgtttctaatcaatggtactctcaatgtttgtaatga

SEQ ID NO: 45 - DNA, 1101 bp, Humicola insolens
atggctaagaagttgtttattactgctgctttggctgctgctgttttggctcaatctggtaatccattttctggtagaactttgttggttaactctgattactcttctaaattggatcaaactagacaagcttttttgtctagaggtgatcaaactaatgctgctaaagttaagtacgttcaagaaaaggttggtactttttactggatttctaacattttcttgttgagagatattgatgttgctattcaaaatgctagagctgctaaagctagaggtgaaaatccaattgttggtttggttttgtataatttgccagatagagattgttctgctggtgaatcttctggtgaattgaagttgtctcaaaatggtttgaatagatacaagaacgaatacgttaatccatttgctcaaaaattgaaagctgcttctgatgttcaatttgctgttattttggaaccagatgctattggtaatatggttactggtacttctgctttttgtagaaatgctagaggtccacaacaagaagctattggttacgctatttctcaattgcaagcttctcatattcatttgtacttggatgttgctaatggtggttggttgggttgggctgataaattggaaccaactgctcaagaagttgctactattttgcaaaaagctggtaacaatgctaaaattagaggtttctcttctaatgtttctaattacaacccatactctacttctaatccaccaccatatacatctggttctccatctccagatgaatctagatacgctactaatattgctaatgctatgagacaaagaggtttgccaactcaattcattattgatcaatctagagttgctttgtctggtgctagatctgaatggggtcaatggtgtaatgttaatccagctggttttggtcaaccatttactactaatacaaacaacccaaacgttgatgctattgtttgggttaaaccaggtggtgaatctgatggtcaatgtggtatgggtggtgctccagctgctggtatgtggtttgatgcttatgctcaaatgttgactcaaaatgctcatgatgaaattgctagataatga

SEQ ID NO: 46 - DNA, 1155 bp, Neurospora crassa
atgagagctttgtctttgttggctgctttgtctgctgctggtgctactgttactgcttctccagttggtccagctcatgctccaagagctttatctgattctaatccatttgttggtaagaagttgtttgctaatccaaaatgggcttctaaattggaagatacttacaaggcttttacttctagaggtgattctgaaaatgctgctgttgttagaaaagttcaaaagattggttcttttgtttgggtttcttctagatctggtttgtctgaaattgatgaagctattcaagctgctagagctgaacaatctagaactggtcaaaaacaaattgttggtttggttatgtacaatattccagatagagattgttctgctggtgaatcagctggtgaattgtctactaaaaacgatggtttgagaatttacaaagaacaattcgttaaaccatatgctgctaaattggctgctgctaaagatttgcaatttgctgttgttgttgaaccagattctttgggtaattctgttactaattctgctgttgaattttgtaaacaagctattccaacttatagagaaggtattgcttttgctattaagtctttgcaattggataatgttgctgtttatttggatgctgctaatggtggttggttgggttggggtgattctttgccaaaagctgctgatgaaattgctactattttgtctatggcttctccagctaaagttagaggtttctctactaatgtttctaattacaacccatacttggctactaaaagagattctttcacttctggttctccatcttatgatgaatctcattacgcttcatctttggctccatatttgcaacaacatggtttgccagctcatttcattattgatcaaggtagagttgcttatccaggtgctagaaaagattggggtgattggtgtaatgttaatccagctggttttggtcatattccaactactgatcaatctgttttgcaaaactctaacgttgatgctattgtttggattaaaccaggtggtgaatctgatggtcaatgtggtttgaaaggtgctccaattgctggtgcttggtttggtggttatgctgaaatgttgactggtaatgctgatgcttctgttaagaattcttaatga

SEQ ID NO: 47 - DNA, 2520 bp, Trichoderma reesei
atgaaggtttctagagttttggctttggttttgggtgctgttattccagctcatgctgctttttcttggaaaaatgttaaattgggtggtggtggtggttttgttccaggtattatctttcatccaaagactaaaggtgttgcttatgctagaactgatattggtggtttgtatagattgaatgctgatgattcttggactgctgttactgatggtattgctgataatgctggttggcataattggggtattgatgctgttgctttggatccacaagatgatcaaaaagtttatgctgctgttggtatgtatactaattcttgggatccatctaatggtgctattattagatcttctgatagaggtgctacttggtcttttactaatttgccatttaaggttggtggtaatatgccaggtagaggtgctggtgaaagattggctgttgatccagctaattctaacattatctacttcggtgctagatctggtaatggtttgtggaaatctactgatggtggtgttactttttctaaggtttcttcttttactgctactggtacttatattccagatccatctgattctaatggttacaactctgataaacaaggtttgatgtgggttacttttgattctacttcttctactactggtggtgctacttctagaatttttgttggtactgctgataacattactgcttcagtttacgtttctactaatgctggttctacttggtctgctgttccaggtcaaccaggtaaatactttccacataaggctaaattgcaaccagctgaaaaagctttgtatttgacttattctgatggtactggtccatatgatggtactttgggttctgtttggagatatgatattgctggtggtacttggaaagatattactccagtttctggttctgatttgtattttggttttggtggtttgggtttggatttgcaaaaaccaggtactttggttgttgcttctttgaattcttggtggccagatgctcaattgtttagatctactgattctggtactacatggtcaccaatttgggcttgggcttcttatccaactgaaacttactactactctatttctactccaaaagctccatggattaagaacaacttcattgatgttacatctgaatctccatctgatggtttgattaaaagattgggttggatgattgaatcattggaaattgatccaacagattctaatcattggttgtatggtactggtatgactatttttggtggtcatgatttgactaattgggatactagacataacgtttctattcaatctttggcagatggtattgaagaattctctgttcaagatttggcttctgctccaggtggttctgaattgttggctgcagttggtgatgataatggttttactttcgcttctagaaatgatttgggtacttctccacaaactgtttgggctactccaacttgggctacttctacttctgttgattatgctggtaattctgttaaatctgttgttagagttggtaatactgctggtactcaacaagttgctatttcttcagatggtggtgcaacttggtctattgattatgcagctgatacttctatgaatggtggtactgttgcttattctgctgatggtgatactattttgtggtctactgcttcttctggtgttcaaagatctcaatttcaaggttcttttgcttctgtttcttctttgcctgctggtgcagttattgcttctgataaaaagactaactctgttttttatgctggttctggttctacattttacgtttcaaaggatactggttcttcatttactagaggtccaaaattgggttctgctggtactattagagatattgctgctcatccaactacagctggtactttgtatgtttctactgatgttggtattttcagatctacagattcaggtacaacttttggtcaagtttctactgctttgactaacacttatcaaattgctttgggtgttggttcaggttctaattggaatttgtacgcttttggtacaggtccatctggtgctagattgtatgcttctggtgattctggtgcttcttggactgatattcaaggttctcaaggttttggttctattgattctactaaagttgcaggttcaggttcaactgctggtcaagtttatgttggtactaatggtagaggtgttttttacgctcaaggtactgttggtggtggtacaggtggtacttcttcttctacaaaacaatcttcttcttcaacttcttctgcttcttcatctactactttgagatcttctgttgtttctactactagagcttctactgttacttcttctagaacatcttctgctgctggtccaactggttctggtgttgctggtcattatgctcaatgtggtggtattggttggactggtcctactcaatgtgttgctccatatgtttgtcaaaagcaaaacgattactactaccaatgtgtttaatga

SEQ ID NO: 48 - DNA, 2577 bp, Aspergillus niger
atgagaagaacttttgctgctttggttgctggttatttgttggattctgttcatgctgctgcttctcaagcttatacttggaagaatgttgttactggtggtggtggtggatttactccaggtattgtttttaatccatctgctaaaggtgttgcttatgctagaactgatattggtggtgcttatagattgaattctgatgatacttggactccattgatggattgggctaacaattctaattggcatgattggggtattgatgctattgctactgatccagttgatactgatagagtttatgttgctgttggtatgtatactaatgattgggatccaaatgatggttctattttgagatctactgatcaaggtgatacatgggaagaaactaaattgccatttaaggttggtggtaatatgccaggtagaggtgttggtgaaagattggctgttgatcctaatgataactctattttgtactttggtgctagatctggtaatggtttgtggaaatctactgattatggtgaaacttggtctaatgttactgcttttaaatggactggtacttactttcaagattcttcttctacttatacttctgatcctgttggtattgcttgggttacttttgattctacttctggttcttcaggttctccaactccaagaatttttgttggtgttgttgatactggtgaatctgtttttgtttctgaagatgctggtgaaacatggacttgggtttctggtgaaccaatgtatggttttttgccacataaaggtattttgtctccatctgaacatactttgtacatttcttactctaatggtgctggtccatatgatggtactaatggtactgttcataagtacaacattacatctggtgtttggactgatatttctccaacttctatgactgatacttattatggttatggtggtttagctgttgatttgcaagttccaggtactgttatggttgctgctttgaattgttggtggccagatgaattgatttggagatctacagattctggtggtacatggtcaccaatttgggcttggaatggttatccatctattaactactactactcttacgatatttctaatgctccatggttgcaagatgatacttctactgatgaatttccagttagagttggttggatggttgaagctttggctattgatccatttgattcagatcattggttgtatggtactggtgaaacaatttacggtggtcatgatttgcaaaattgggattctgaacataacgttactattgaatctttggcagttggtattgaagaaatggctgttttgggtttgattactccaccaggtggtccagctttgttgtctgctgttggtgatgatggtggtttttatcatacttctttgactactgctccatctcaatattatcatactccaacttactcttctactaatggtattgattacgctggtaacaaaccagctaatattgttagatctggttcttctgattctgatccaactttggctttatcttcttcttttggtgaatcttggtatgctgattatgctgcttcttcttcaactgctactggtcaagttgctttgtctgctgatgctgatactattttgttgatgaattcagatggtgcttacagatctgctaattctgctactttatctgctgtttcttctttgccatctggtgctgttattgcttctgataaggctaacaatacttacttttatggtgcttctggttcatctttttacttgtcatctgatactgctgctacttttactgttactactactttgggttcttctactactgctaatgctattagagcacaaccatctttggctggtgatgtttgggtttctactgatactggtttgttccattctactaattacggtaaatctttcactcaaattggttctggttgtactgaaggttggtcttttggttttggtaaaccatcttctgatggtgattatccagttttgtttggttttttcactgttgatggtgttacaggtttgtttaagactgaagatcaaggtgttaactggcaaatcatttctgatgctgaacatggttttggttctgcttcagctaatgttgttaacggtgatttacaaaattacggtagagttttcgttggtacaaatggtagaggtattttctatggtgatccatctggtactttaccatctgctactgctactgcttcttctgcttcatctacagctgttaaatcttctacttctacatctacttctaaagttggttcttctacaacagtttcttcatctactgctactactattactacttcttctattaagtctactactttgactacaactactaagtcatcttcttcaacaacttctacttcttcaacagcaacaggtactgcttctgcttatggtcaatgtggtggttctggttttacaggtccaactcaatgtccatctggttggacttgcacttatgaaaacgaatactactctcaatgtaaatctattccaggtattgctacagatagaggttaatga

SEQ ID NO: 49 - DNA, 2574 bp, Aspergillus aculeatus
atggctagatcttctttggctttgttgtgtgctgctttgttgggtaaattggctgatgctgctgcttctcaagcttatacttggaagaatgttgttactggtggcggtggtggttttactccaggtattgtttttaatccatctgctaaaggtgttgcttatgctagaactgatattggtggtgcttatagattgaattctgatgatacttggactccattgatggattgggttggtaatgatacttggcatgattggggtattgatgctttggctactgatccagttgatactgatagagtttatgttgctgttggtatgtatactaatgaatgggatccaaatgttggttctattttgagatctactgatcaaggtgatacatggactgaaactaaattgccatttaaggttggtggtaatatgccaggtagaggtatgggtgaaagattggctgttgatccaaacaaaaactctattttgtactttggtgctagatctggtcatggtttgtggaaatctactgattatggtgctacttggtctaatgttacttcttttacttggactggtacttattttcaagattcttcttctacttatacttctgatcctgttggtattgcttgggttacttttgattctacttctggttcttcaggttctgctactccaagaatttttgttggtgttgctgatgctggtaaatctgtttttaagtctgaagatgctggtgctacatgggcttgggtttctggtgaaccacaatatggttttttgccacataaaggtgttttgtctccagaagaaaagactttgtacatttcttatgctaatggtgctggtccatatgatggtactaatggtactgttcataagtacaacattacatctggtgtttggactgatatttctccaacttctttggcatctacttattacggttatggtggtttgtctgttgatttgcaagttccaggtactttgatggttgctgctttgaattgttggtggccagatgaattgatttttagatctacagattctggtgcaacatggtcaccaatttgggaatggaatggttatccatctattaactactactactcttacgatatttctaatgctccatggattcaagatactacttctacagatcaatttccagttagagttggttggatggttgaagctttagctattgatccattcgattctaatcattggttgtatggtactggtttgactgtttatggtggtcatgatttgactaattgggattctaagcataatgttactgttaaatctttggcagttggtattgaagaaatggctgttttgggtttgattactccaccaggtggtccagctttgttatctgctgttggtgatgatggtggtttttatcattctgatttggatgctgcacctaatcaagcttatcatactccaacttacggtactactaatggtattgattacgctggtaacaaaccatcaaacattgttagatctggtgcttctgatgattatccaactttggctttatcttctaattttggttctacttggtatgctgattatgctgcttctacttctactggtactggtgctgttgctttgtctgctgatggtgatactgttttgttgatgtcatctacatctggtgctttagtttctaaatctcaaggtactttgactgctgtttcttctttgccatctggtgctgttattgcttctgataagtctgataacactgttttttatggtggttctgctggtgcaatttacgtttctaagaacactgctacatcttttactaagactgtttctttgggttcttctactactgttaatgctattagagcacatccatctattgctggtgatgtttgggcttctactgataaaggtttgtggcattctacagattacggttcaacttttactcaaattggttctggtgttactgctggttggtcttttggttttggtaaagcttcttctactggttcttacgttgttatctacggtttcttcactattgatggtgctgctggtttgtttaaatcagaagatgcaggtactaattggcaagttatttctgatgcttctcatggttttggttctggttctgctaatgttgttaacggtgatttgcaaacttatggtagagtttttagaggtcatgaaagaccaggtcatttgttgagacaatctcaaagagaaccagctggtagacatggtgatggtgacggtgatactactacttctaagacttctactacagtttctactactttgaaaactactacatcttctgcttctactacttcttcttcaacaactgttaagactacaacttcttcatcttctactacatctaaagcttcatctacaactactactaagacaacaactacttctactactacatcatcaggtactactgctactgcttctgcttatgcacaatgtggtggtaatggttggactggtgctactgtttgttttactggttacacttgtacttactctaatgctttctactctcaatgtgttccatcttaatga

SEQ ID NO: 50 - DNA, 2544 bp, Neosartorya fischeri
atgatgcatactttgaacgttgttttgttggctgctggtttgttgtttgatgttgctcatgctgctgcttctcaagcttatacttggaagaatgttgttactggtggtggtggtggctttgttccaggtattgtttttaatccatctgctaaaggtgttgcttatgctagaactgatattggtggtgcttatagattgaattctgatgatacttggactccattgcaagattctgttggtaattctaattggcatgattggggtgttgatgctttggctactgatccagttgatacttctagattgtatttggctgttggtatgtatactaatgaatgggatccaaatgttggttctattatgagatctactgataaaggtaatacttggtctgaaactaaattgccatttaaggttggtggtaatatgccaggtagaggtatgggtgaaagattggctgttgatccaaacaaaaactctattttgtactttggtgctagatctggtcatggtttgtggagatctacagattatggtgcaacttggtctaatgttacttcttttatttggactggtacttattttcaagatgcttcttctacttatacttctgatcctgttggtattgcttgggttacttttgattctacttctggttctaatggttctccaactccaagaatttttgttggtgttgctgatacttctaagtctgttttcgtttctgaagatgctggttctacatggtcttgggttactggtgaaccacaatatggttttttgccacataaaggtgttttgtctccagctgaaaaaactttgtacatttcttactctaatggtgctggtccatatgatggtactaatggtactgttcataagtacaacattacttctaaagtttggactgatatttctccaacaccaatggcttctacttattatggttatggtggtttgtctgttgatttgcaagttccaggtactttgatggttgctgctttgaattgttggtggccagatgaattgatttttagatctgttgattctggtgcaacatggtcaccaatttgggcttggaatggttatccaaatttgaactactactactcttacgatatttctaatgctccatggttgcaagatgatacttctactgctcaatttccagttagagttggttggactgttgaagctttagcaattgatccattcgattctaatcattggttgtatggtactggtgctacaatttatggtggtcatgatttgaaacaatgggatacagttcataatgttactttgaagtctttagcagttggtattgaagaaatggctgttttgggtttgatttctccaccaggtggtccaccattgttgtctgctgttggtgatgttggtggtttttatcattctgatttggataaagctccagctcaatcttttcataatccaacttacggtactactaatggtattgattacgctggtaacaaaccatctaatttggttagatctggtgcttctgatactttgccaactgttgctatgtctactgattttggtaaaacatggtctgctaattatgctgcttcttcaactactccaactggtcaagttgctttgtctgctgatgctgatactgttttgttgatgaattctaacggtgttatggtttctaaatactcttctactttctctgctgtttcttctttgccatctggtgctgctattgcttctgataagtctaacaacactgttttttatggtggttctgctggtgctttttatgtttctactgatggtgctacatcttttactaaaactgcttctttgggttcttctactgctgttaatgctattagagcacatccatctattgctggtgatgtttgggctactactgatactggtttgtggcattctactgattacggtaagactttcactaaaattgatggtggttgtactgctggttggtcttttggtttgggtaaagcttctccaactggttcttatgctgttatctacggttttttcactgttgatggtactactgctttgtttaagactgaagatatgggtatgaattggcaaatgatttctgattctactcatggttttggtgctgcttcagctaatgttgttaacggtgatatgtctaattatggtagagttttcgttggtacaaatggtagaggtattttctatggtcaaccatctggttctttaccatctccaactgctactgctactactacaaaaactacttctacttctactaaaacttctggtactactacttcttctactactttgtctacaactactaagacttctactacaactacatctactactaagacaacaacttctccaacttctacaggtacttctactccatatggtcaatgtggtggtactggttatactggtccaactgcttgtccatctggttggaaatgtacttatcaaaacgcttactactctcaatgtgaatttgaacatttgaaaaagactggtaagcatttggatagataatga

SEQ ID NO: 51 - DNA, 786 bp, Chaetomium thermophilum
atggtcaacttctctactttgtttttggctgcttctactgctgctttggctgctgctgctccatctattgaaaaaagacaaaccttgacttcttctgctactggtactcataatggttactactactctttttggactgatggtcaaggtaatattagattcaacttggaatctggtggtcaatattctgttacttggtctggtaatggtaattgggttggtggtaaaggttggaatccaggtactgataatagagttattaactacactgctgattatagaccaaatggtaattcttatttggctgtttatggttggactagaaatccattgattgaatactacgttgttgaatcttttggtacttatgatccatctactggtgctactagaatgggttctgttactactgatggtggtacttacaatatctacagaacccaaagagttaacgctccatcaattgaaggtactaagactttttatcaatactggtctgttagaacttctaaaagaactggtggtactgttactatggctaatcattttaatgcttggagacaagctggtttgcaattgggttctcatgattatcaaattgttgctactgaaggttattattcttctggttctgctactgttaatgttggtggttctactactggtggtaacaacggtggaaacaatggcggtaacaatggtggcaacaacggaggcaatactggttctaacgtttctatttctagaccaagaaaaatgggttctttggcttctactagatcataa

SEQ ID NO: 52 - DNA, 672 bp, Artificial Sequence
  synthetic version of Trichoderma reesei
atggtttccttcacttctttgttggctggtgttgctgctatttctggtgttttggctgctccagctgctgaagttgaatctgttgctgttgaaaagagacaaactattcaaccaggtactggttacaacaatggttactttcattcttattggaatgatggtcatggtggtgttacttatactaatggtccaggtggtcaattttctgttaattggtctaattctggtaattttgttggtggtaaaggttggcaaccaggtacaaaaaacaaggttattaacttctctggttcttacaatccaaatggtaactcttatttgtctgtttatggttggtctagaaatccattgattgaatactacatcgttggtaattttggtacttacaatccttctactggtgctactaaattgggtgaagttacttctgatggttctgtttatgatatctacagaacccaaagagttaatcaaccatccattattggtactgctactttttatcaatactggtccgttagaagaaatcatagatcatctggttctgttaatactgctaatcattttaatgcttgggctcaacaaggtttgactttgggtactatggattatcaaattgttgcagttgaaggttatttttcttctggttctgcttctattactgtttcttaa

SEQ ID NO: 53 - DNA, 672 bp, Trichoderma reesei
atggtctccttcacctccctcctcgccggcgtcgccgccatctcgggcgtcttggccgctcccgccgccgaggtcgaacccgtggctgtggagaagcgccagacgattcagcccggcacgggctacaacaacggctacttccactcgtactggaacgatggccacggcggcgtgacgtacaccaatggtcccggcgggcagttctccgtcaactggtccaactcgggcaactttgtcggcggcaagggatggcagcccggcaccaagaacaaggtcatcaacttctcgggcagctacaaccccaacggcaacagctacctctccgtgtacggctggtcccgcaaccccctgatcgagtactacatcgtcgggaactttggcacctacaacccgtccacgggcgccaccaagctgggcgaggtcacctccgacggcagcgtctacgacatttaccgcacgcagcgcgtcaaccagccgtccatcatcggcaccgccaccttttaccagtactggtccgtccgccgcaaccaccgctcgagcggctccgtcaacacggcgaaccacttcaacgcgtgggctcagcaaggcctgacgctcgggacgatggattaccagattgttgccgtggagggttactttagctctggctctgcttccatcaccgtcagctaa

SEQ ID NO: 54 - DNA, 1152 bp, Chrysosporium lucknowense
atgaggaccttgacttttgttttggctgctgctccagttgctgttttggctcaatctccattgtggggtcaatgtggtggtcaaggttggactggtccaactacttgtgtttctggtgctgtttgtcaatttgttaacgattggtactctcaatgtgttccaggttcttctaatccaccaactggtactacatcttctactactggttctactccagctccaactggtggtggtggttctggtactggtttgcatgataagtttaaagctaaaggcaaattgtatttcggtactgaaattgatcattaccacttgaacaacaatgctttgactaacattgttaagaaggattttggtcaagttactgaaaattctttgaaatgggatgctactgaaccatctagaaatcaatttaacttcgctaatgctgatgctgttgttaattttgctcaagctaacggtaaattgattagaggtcatactttgttgtggcattctcaattgccacaatgggttcaaaacattaacgatagaaacactttgacacaagttattgaaaaccatgttactactttggttacaagatacaagggtaagattttgcattgggatgttgttaatgaaattttcgctgaagatggttctttgagagattctgttttctctagagttttgggtgaagattttgttggtattgcttttagagctgctagagcagctgatccaaatgctaaattgtacatcaacgattacaatttggatattgctaattacgctaaagttactagaggtatggttgaaaaagttaacaaatggattgctcaaggtattccaattgatggtattggtactcaatgtcatttggctggtccaggtggttggaatactgctgctggtgttccagatgctttgaaagctttagctgctgctaatgttaaagaaattgccattaccgaattggatattgccggtgcttctgctaatgattatttgactgttatgaacgcttgtttgcaagtttctaagtgtgttggtattactgtttggggtgtttctgataaagattcttggagatcatcttctaatcctttgttgttcgattctaattatcaaccaaaagctgcttacaatgcattgattaacgctttgtaa

SEQ ID NO: 55 - DNA, 1086 bp, Aureobasidium pullulans
atgcacttctctactattactgctgctttggctttgttgggtttgggtgctgctactccaactgattattctacttcttcctactctaaaaatcaaggtttggctcaagcttggacttctaaaggtagacaatatattggtactgctttgactattagagatgatccagttgaacaaggtattattcaatctagaaccgatttcaattctattactccagaaaatgctatgaaatgggaatctactgaaccacaaagaaacaattttacttttgctggtgctgatgctgttgctgattttgctgacagatacaacaaagaaatgagatgtcatactttggtttggcattctcaattgccagcttgggtttctcaaggtaattttgataacaagaccttgatttccattatggaaaaccatattaagaaagttgctggtaggtataaaaacaaatgtacccattgggatgttgttaatgaagctttgaatgaagatggtacttatagatcctctgttttctacaatactattggtgaagcttttattccaattgctttcagatttgctgaaaaatatgctggttctaagactaaattgtactacaacgactacaatttggaatatggttctgctaaagctttgggtgctcaaagaattttgaagttggttcaatcttatggtgttcaaattgatggtgttggtttgcaagctcatttgtcatctgaagctactgcttctactggtggtggtgttactccagatgttcaaactttgactaacgttttgaagttgtatactgatttgggtgttgaagttgcttatacagaattggatgttagatttactactccagctactgatgctaaattgaaagctcaagctgatgcttatgctagagttgttcaatcttgtatcaacgttaaaagatgtgttggtattactgtttggggtgtttctgataagtattcttggattccaggtgtttttccaactgaaggtgctgctttgttgtgggatgaaaatttcaacaaaaagccagcttattcttctgttttgaaaaccattcaatctttcagaaagtcctaa

SEQ ID NO: 56 - DNA, 2604 bp, Aspergillus niger
atgagatttccttcaatttttactgcagttttattcgcagcatcctccgcattagctgctccagtcaacactacaacagaagatgaaacggcacaaattccggctgaagctgtcatcggttacttagatttagaaggggatttcgatgttgctgttttgccattttccaacagcacaaataacgggttattgtttataaatactactattgccagcattgctgctaaagaagaaggggtatctttggataaaagagaggctgaagcttatcgatacaccagctatgtcgattacaacgtcgaggccaaccctgacttgtaccctttgtgcatagaaaccatcccactgagcttccccgactgccagaatggccccctgcgcagccacctcatctgcgacgaatcagccaccccctatgaccgagcagcatcgctcatctcgctcttcacgctggacgagctgatcgccaacaccggcaacaccggcctcggtgtctcccgactgggcctccctgcataccaagtatggagtgaagcacttcacggcctcgaccgtgccaacttcagcgactcaggctcctacaattgggctacttcattcccccaacctatcttgaccaccgcggccctcaaccgcaccctcattcaccaaatcgcctccatcatctccacccaaggccgtgccttcaacaacgccggccgctacggcctcgatgtctacgcccccaacatcaacaccttccgccaccccgtctggggtcgcggacaagaaactccaggagaggacgtctctctcgccgccgtctacgcctacgaatacatcaccggcatccagggtcccgacccagactcaaacctcaaacttgccgccacggccaagcactacgccggctatgacatcgagaactggcacaaccactcccgcctgggcaatgatatgaacatcacccagcaagacctgtcagaatactacactccccagttccacgtcgccgcccgcgacgccaaagtccacagtgtcatgtgtgcctataacgccgtcgacggcgtccctgcctgcgccgactcttacttcctccagaccctcctccgcgacaccttcggattcgttgaccacggctacgtctccagcgactgcgacgccgcctacaacatctacaatccccacggctacgcctcctcccaggctgccgctgccgctgaggccatcctcgctggcactgacatcgactgcggtaccacctaccaatggcacctgaacgagtccatcactgcgggagatctctctcgcgatgatatcgagaagggtgtgatccgcctctacacgacccttgtgcaggccggatacttcgactccaataccaccaaggcgaacaacccctaccgcgacctcacctggtccgatgtcctcgagacggacgcatggaacatctcctaccaagccgcgacgcagggcattgtccttctcaagaactccaacaacgtccttcccctcaccgagaaagcttacccaccatccaacaccaccgtcgcccttatcggtccctgggccaacgccaccacccaactcctgggcaactactacggcaacgctccctacatgatcagcccccgcgccgcgttcgaagaagccggatacaaagtcaacttcgccgaaggcaccggtatctcctccacaagcacctcgggcttcgcagccgccttatccgccgcccggtccgccgacgtgatcatctacgccggtggtatcgacaatactcttgaagcggaggcactggatcgcgagagcatcgcatggccgggtaaccaactggacttgatccaaaagctcgcctcgtcggccggaagcaagccgctcatcgttctccaaatgggcggcggacaggtcgattcctcgtccctcaagaacaacacgaacgtcactgcactcctctggggcggataccccggccaatccggcggtttcgctctgagagacatcatcacgggaaagaagaaccccgcgggtagactagtcacgacacaatacccagccagctacgcggaggagttccccgcgacggatatgaacctccgtcctgagggtgataaccccggccaaacatacaaatggtacaccggcgaagcagtgtacgagttcggccacggattattctacacgaccttcgcggaatcatccagcaacaccactacgaaggaagttaagctcaacatccaggacattctttcccagacacacgaagagctagcctcaattacgcagctccctgtgctgaacttcactgccaatatcaagaacactggaaagctggaatcggattacaccgctatggtattcgccaatacctctgatgccggtccggcgccgtacccggtgaagtggctggtcgggtgggatcggcttggggatgtgaaggtcggggagacgagggagttgagggttcccgttgaggtggggagctttgcgagggtgaatgaggatggcgattgggtgttgtttccgggaacgtttgagttggcgttgaacctggagaggaaggttagggtgaaggttgttcttgagggtgaggaggaagtcgtgctgaagtggcctgggaaggagtag

SEQ ID NO: 57 - DNA, 2409 bp, Aspergillus nidulans
atgttgttgcaagcttttttgtttttgttggctggttttgctgctaaaatttctgctaacacttcttacactgattacaatgttgaagctaatccagatttgtttccattgtgtttgcaacatttgaatgcttcatttccagattgtgctactggtccattgtctttaactccagtttgtgatagatcattgtctccaaaagatagagctactgctttggtttctttgtttacctttgatgaattggttaacaatactggtaatacaggtttgggtgtttctagattgggtttgccaaattatcaagtttggggtgaagctttgcatggtgttggtagagctaattttgttgaatctggtaatttttcttgggctacttcttttccaatgccaattactatgatggctgctttgaacaaaactttgattcatcaaatcggtactattgtttctactcaattgagagctttttctaatgctggtttgggtggtgttgatgtttattctccaaacattaacacttttagacatccagtttggggtagaggtcaagaaactccaggtgaagatgcttttttgacttctgtttacggttatgaatacattactgctttgcaaggtgctgttgatccagaaacttctaagattattgctactgctaaacattatgctggttacgatattgaatcttggaacaaccattctagattaggtaacgatatgcaaattacccaacaagaattgtctgaatattacactccaccatttattgttgcttctagagatgctaaagttagatcagttatgtgttcttacaatgctgttaatggtgttccatcttgtgctaacaagtttttcttgcaaactttgttgagagataccttcgaattttctgaagatggttacgtttctggtgattgtggtgctgtttacaatgtttggaatccacatggttatgcttctaatgaagctgctgcttctgctgattctattttggctggtactgatattgattgtggtacttcttatcaatggcattctgaagatgcatttgaagattctttggtttctagatccgatattgaaagaggtgttattagattgtactccaatttggttcaagctggttattttgatggtgaagatgcaccatatagagatattacttgggatgatgttttgtctactgatgcttggaatattgcttatgaagctgcagttgaaggtattgttttgttgaagaacgatgaaactttgccattgtctaaggatattaagtctgttgctgttattggtccatgggctaatgttactgaagaattgcaaggtaattactttggtccagctccatatttgatttctccattgactggttttagagattctggtttggatgttcattatgctttgggtactaatttgacttctcattctacatctggttttgaagaagctttgactgctgctaaacaagctgatgctattatctttgccggtggtattgataatactattgaagctgaagctatggatagagaaaacattacttggccaggtaatcaattggatttgatttctaagttgtctgaattgggtaaaccattggttgttttgcaaatgggtggtggtcaagttgattcttcatctttgaaggataacgataatgttaatgctttgatttggggtggttatccaggtcaatctggtggtcatgctttggctgatattatcactggtaaaagagcaccagctggtagattggttactactcaatatccagctgaatatgctgaagtttttccagctattgatatgaatttgaggccaaatgaaacttctggtaatcctggtcaaacttatatgtggtatactggtactccagtttatgaatttggtcatggtttgttttacactactttcgaagaatctactgaaactactgatgctggttcttttaacattcaaactgttttgactactccacattctggttatgaacatgctcaacaaaagactttgttgaatttcactgctactgttaagaatactggtgaaagagaatctgattatacagctttggtttacgttaatactactgctggtcctgcaccatacccaaaaaaatgggttgttggttttgatagattgggtggtttggaaccaggtgattctcaaactttgactgttccagttactgttgaatctgttgctagaactgatgaacaaggtaatagagttttgtatccaggttcttatgatgttgcattgaacaatgaaagatccgttgttgttaagtttgaattgaaaggtgaagaagctgttattttgtcttggccagaagatactacttctgatttcgtttcttctattgatggtggtttggatagaaaacaagatgttatcgcctaa

SEQ ID NO: 58 - DNA, 987 bp, Cochliobolus carbonum
atgtccgttcaagcttatgatccaccattgatttctactttccatcaatgtgatccagctgctcatgtttggaaacatgatccaaacactgtttacatttacggttctcatgattggaactctactagacaaccaccagttcaatatgatatgaaggattactacgttttaactcaaactgattacactaaaccagctactgttggtccaaaattgttggatttggttgatattccatgggctactcaacaattgtgggctccagatgctactgaaaaagatggtcaatactacttgttttttccagctaaagataaggatgatgttttcagaattggtgttgctaaatctgataaaccagacggtaaattcaaaccagaaccaaatccaattgctggtacttattctattgatccaaccattttggaagataatggtaactattatatggtttggggtggtttgtggggtggtcaattgcaagcttggactaacaatgttttgaacacttctttgtttggtaacaatgctccaacttctggtccagctattggtccaagatttgctaaattgtctgctaatttgacttctttggctactactccaaaagaattggttatctacgatcaagatggtaaagttatgcaagctggttctactagaagattttttgaaggtccatctttgaacaaagttggtaacttgtacgttttgcaatattctactggtacttctcatactgttgaaattgctactgctactaaaccagatggtccatattattggaaatctaccttgttgcaaccagttaaaggttggactactcatgaatctattgtcaagtttaagaacgattggttgttgtattatgctgatgcttctttgtctggtagagatgatttgagaaacactaaggtcagaaagattttgtttgaaaacggtacttttaagttggctcaaccacaaccagttattccatcttcttaa

SEQ ID NO: 59 - DNA, 1008 bp, Penicillium herquei
atggacccaaagccattgattactcatttgtatactgctgatccatctgctcatgtttttaacggtaagctatacatttatccatctcatgatagagaaactgatattgcttttaacgataacggtgatcaatatgatatgaccgattaccatgttttttctatggattctattgatggtccagttgaagattctggtgttgttttgtctgctaaagatgttccatgggtttctaaacaaatgtgggctccagatgctgctactaaaaatggcaaatactacttggtttttccagctagagatcaagaaggtattttcagaattggtgttgctatttctgattctccaactggtccatttgctccagaaaaaaactatattccaggttcttattctattgatccagctgtttttgttgatgaagatgaaaaaccatacttgtactttggtggtatttggggtggtcaattgcaatgttgggaaaaatctggttctgaagttaaagaaggtgatgaaatgaacggtttggtttttaatgcttctaaatctggtccacaagaaccatctggtgatggtgttccagctttgtgtccaagagttggtcaattgtctgatgacatgttgacttttgtttctccaccacaagaattgcaaattttggctccagaaactggtgaaccaattgctgctgatgatcatgaaagaagattttttgaagctgcttggatgcacagatataatggtcaatactacttctcttattctactggtgattctcattatttggtttatgctactggttcttctccattgggtccatttacttatcaaggtagaattttggaaccagttttgggttggactactcatcattccattgttgaatttcaaggtaaatggtacttgtttttccatgattgtgaattgtctggtggtgttaatcatttgagatccgttaaggttagagaaattgtttatgatgctgaaggtaaaattcatttggcttaa

SEQ ID NO: 60 - DNA, 996 bp, Pyrenophora tritici-repentis
atgtccgttgctgtttatgatccaccagttattaacactttccatcaatgtgatccagctgctcatgtttggaaacatgatccaaatactgtttacgtttacggttctcatgatgttaattctactaagaatccaccagttcaatatgatatgaaggattactacgttttgattcaagttgatattactaaaccagctactgttggtccaaagattttggatttgccagatattccatgggcttctcaacaattgtgggctccagatgttgctgaaaaaaatggtgaatacttcttgtattttccagctaaagataaggatggtgtttttagaattggtgttgctaaatctgataaaccagacggtaaattcaaagctgaaccatcttatattccaggtgcttattctattgatccagctattttggctgatgatgatggttgttactacatgtattttggtggtttgtggggtggtcaattgcaagcttggccaaacaatactttgaatacttctgctttcggtaatatttctccatcttctggtccagctttgggtccaagatttgctaaattgtctgctaatatgacacatttggctactgaaccaaaagaattggttatctacgataaagatggtcaagttatgcaagctaattctactagaagatactttgaagctccatctattaacaaagttggtaacttgtattacttgcaatattctactggtacttctcatactattgaaattgctgttggtaaaaaaccagaaggtccattttattggaaatctaccttgttgcaaccagttaaaggttggactactcatgaatctattgttaagtttaagggtgattggttgttgtattatgctgatgcttctttgactggtattgatgatttgagaaacactaaggttagaaagttgaattttgctaatggtacttttgctttggctcaaccacaaccatatactccatttccatcttcataa

SEQ ID NO: 61 - DNA, 1131 bp, Aspergillus aculeatus
atgaagctttctcacatgctcctcagcctcgccagcctgggggtggcgacggctcttccccggacgccgaaccacaacgcggccaccaccgccttccccagcacctcggggctgcacttcacgattgacggcaagacgggctactttgccgggaccaactcgtactggatcgggttcctgaccaacaacgacgacgtggacctcgtcatgagccagctggcggcatccgacctcaagatcctgcgggtctgggggttcaacgacgtcaacaccaagcccaccgacgggacggtgtggtaccagctgcacgcgaacggcacctcgaccatcaacacgggcgcggacgggctccagcgcctcgactacgtggtgacctcggccgagaagtacggcgtcaagctgatcatcaacttcgtcaacgagtggaccgactacggcggcatgcaggcctacgtcacggcctacggcgccgccgcccagacggacttctacaccaacaccgccatccaggccgcctacaagaactacatcaaggcggtcgtctcgcggtacagcagctccgccgccatcttcgcctgggagctggccaacgagccccgctgccagggctgcgatacctcggtcctgtacaactggatctcggacacgtccaagtatatcaagtcgctggactccaagcacctggtcacgattggcgatgagggcttcggtctcgacgtcgactccgacggcagctacccctacacctacggcgagggattgaacttcaccaagaacctgggcatctcgaccatcgacttcggtactctgcatctgtaccccgatagctggggcacctcctacgactggggcaacggctggatcacggcccacgcggccgcctgcaaggcggtgggcaagccgtgcctgctggaagagtacggagtgacctccaaccactgtgccgtcgagagcccctggcagcagacggccggcaacgcgacgggcatctccggcgatttgtactggcagtatggcaccacgttcagctggggccagtccccgaacgatgggaacaccttctactacaacaccagcgacttcacgtgcctggtgacggatcatgtggcggccatcaatgcgcagtcgaag

SEQ ID NO: 62 - DNA, 2799 bp, Aspergillus niger
atgagacattctattggtttggctgctgctttgttggctccaactttgccagttgctttgggtcaacatattagagatttgtcatctgaaaaatggactttatcttctagagctttgaatagaactgttccagctcaatttccatctcaagttcatttggatttgttgagagctggtgttattggtgaatatcatggtttgaacgattttaacttgagatggattgctgctgctaattggacttatacttctcaacctattaagggtttgttggataattatggttctacttggttggtttttgatggtttggatacttttgctactatttctattttgtggactgctaatagaatccatggtcaatctgtttctccagtttctggttctatgtatttgccagctttggaagcttgtcaaagaagaattttgattagaaaggtttcttttagaggtggtgttactgctgaagttaatacttgttacttgcatattgaatggccagatgatgttcaattgacttacgaatatccaaatagatggttcatgagaaaagaacaatctgattttggttgggattggggtccagcttttgctccagctggtccatggaaaccagcttatatcgttcaattggataagaaagaatctgtttacgttttgaacactgatttggatatctacagaaagaatcagattaactatttgccaccagatcaatctcaaccatgggttgttaatgcttctattgatattttgggtccattgccagctaaacctactatgtctattgaagttagagatactcattctggtactattttgacttctagaacattgaacaatgtttctgttgctggtaatgctattactggtgttactgttttggatggtttgaatccaaaattgtggtggccacaatcttcagttattagaacttctactatgttcttgtctttgtctaaagttgaaggtactagaccatggccagtttggactaatggtagagcttctgctccattttttttgaatcaaagaaacattactgaagttcaaagagcacaaggtattgctccaggtgctaattggcattttgaagttaatggtcatgaattttacgctaagggttctaatttgattccaccagattctttttggactagagttactgaagaaagaatttctagattattcgatgctgttgttgttggtaatcaaaacatgttgagagtttggtcatctggtgcttacttgcatgattacatctatgatttggctgatgagaaaggtattttgttgtggtctgaatttgaattttctgatgcattatacccatctgatgatgcttttttggaaaatgttgctgctgaaatcgtttacaacgttagaagagttaatcatcatccatctttggctttgtgggctggtggtaacgaaattgaatctttgatgttgccaagagttaaggatgctgctccatcttcttattcttattacgttggtgaatacgaaaaaatgtacatttctttgttcttgccattggtttacgaaaacactagatctatttcttattctccatcttctactactgaaggttacttgtacattgatttgtctgctccagttccaatggctgaaagatatgataacactacttctggttcttattatggtgatactgatcattatgattacgatacttcagttgcttttgattatggttcttatccagttggtagatttgctaatgagttcggttttcattctatgccatctttacaaacttggcaacaagctgttgatactgaagatctatacttcaactcttctgttgttatgttgagaaatcatcatgatccagctggtggtttgatgactgataattacgctaattctgctactggtatgggtgaaatgactatgggtgttatttcttattatcctattccatctaagtctgatcatatttctaatttctctgcttggtgtcatgctactcaattatttcaagctgatatgtacaagtctcaaattcaattttacagaagaggttctggtatgccagaaagacaattgggttcattatattggcaattggaagatatttggcaagctccatcttgggctggtattgaatatggtggtagatggaaagttttacatcatgttatgagagatatctaccaaccagttatcgtttctccattttggaattatacaactggttctttggatgtttatgttacttctgatttgtggtcaccagctgctggtactgttgatttgacttggttggatttgtctggtagaccaattgcaggtaatgctggtactccaaaatctgttccttttactgttggtggtttgaactctactagaatctacggtacaaacgtttcttctttgggtttgcctgatacaaaagatgctgttttgattttgtctttatctgctcatggtagattgccaaattctgatagaactacaaacttgactcacgaaaattatgctactttgtcttggccaaaagatttgaaaatcgttgatccaggtttgaaattgggttactcttctaaaaaaactactgttactgttgaagctacttctggtgtttcattatacacatggttggattatccagaaggtgttgttggttactttgaagaaaatgcttttgttttggctccaggtgaaaaaaaagaaattggtttcacagttttggatgatacaactaatggtgcttgggttagaaatattactgttcaatctttgtgggatcaaaaagttagaggttaatga

SEQ ID NO: 63 - DNA, 2794 bp, Aspergillus aculeatus
atgagagctttgccaactactgctactactttgttgggtgttttgttttttccatctgcttctagatctcaatatatggactttatcttctgctactttgaatagaactgttccagctcaatttccatctcaagttcatatggatttgttgagagaaggtattattgatgaaccatacaacgatttgaatgattttaacttgagatggattgctgatgctaattggacttatacttctggtaaaattgaaggtttgggtgaagattatgaatctacttggttggtttttgatggtttggatacttttgcttctatttctttctgtggtcaatttgttggtgctactgataatcaattcagacagtacatgttcgatgtttcttctattttgaaagcttgtccagaagaacctactttgggtattcaatttggttctgctccaaatatcgttgatgctattgctcaagatccatcttctccaacttggccagaaggtgttcaaattacttacgaatacccaaatagatggttcatgagaaaagaacaatctgattttggttgggattggggtccagcttttgctccagctggtccatggaaaccaggttatgttgttcaattgaaacaagctgctccagtttatgttagaaacactgatttggatatctatagattgggtcaaatcaattatttgccaccagatcaaactcaaccatgggttgttaatgcttcattggattatttgggttctttgccagaaaatccatctatggctattgaagttaaggacttgcaatctggtgaaattttggcttctagaccattgactaacattactgttactgaaggttctgttactggtgttactgttttggaaggtgttgatccaaaattgtggtggccacaaggtttaggtgatcaaaacttgtacaacgttactatttctgttactgatggtggtaatcaatctgttgctgaagttacaaaaagaactggtttcagaactattttcttgaatcaaagaaacattactgatgctcaattggctcaaggtattgctccaggtgctaattggcattttgaagttaacggtcatgaattttatgctaagggttctaatttgattccaccagactgtttttggactagagttactgaagatacaatgactagattattcgatgctgttgttgctggtaatcaaaacatgttgagagtttggtcatctggtgcttacttgcatgattacatctatgatttggctgacgaaaaaggtattttgttgtgttctgaatttcaattttctgatgcattatacccaactgatgatgcttttttggaaaatgttgctgctgaagttgtttacaatgttagaagagttaatcatcatccatctttggctttgtgggctggtggtaacgaaattgaatctttgatgttgttgttggttgaagctgctgatccagaatcttatccattttacgttggtgaatacgaaaaaatgtacatttctttgttcttgccattggtttacgaaaacactagatctatttcttattctccatcttctactactgaaggttacttggatattgatttgtctgctccagttccaatggctgaaagatattctaacactacagaaggtgaatattacggagatactgatcattataactacgatgcttctattgcttttgattatggtacttatccagttggtagatttgctaatgaatttggttttcattctatgccatctttacaaacttggcaacaagctttgactgatccagctgatttgacttttaactcttctgttgttatgttgagaaatcatcattatccagctggtggtttgatgactgataattaccataatactgttgctagacatggtagaaatgatccaggtagagctggtttgttgccagatgctcaacattctgttagaccaagaggtcaattgcaaagattggttccaagagatccagctttgccaggtggtccattgcaagttactaatccagttttaccagctggtcaaagagctgctagaactccagctagagttccagttttggctgctagaggtcatttggctggtgctttggttggtggtgatagagttaggagaccattggaaggtccacattatgttgctagagatatctacaagccagttatcgtttctccattttggaattatacaacaggtgcattggatatctacgttacttctgatttgtggactgctgctgctggttctgttacattgacttggagagatttgtctggtaaacctattgcttctaatggtggtttgccaacaaaaccattgccatttcatgttggtgctttgaactctactagattatacagaatgaacatgaagcaacaaccattgccaagacatgaagatgctattttggctttggaattgactgctactggttctttaccaaatactgatgaagaagttactttcactcacgaacaatggtttactccagcttttccaaaagatttggatttggttaacttgagagttagagttgaatatgatgctccattgggtaaatttgctgttgaagctactgctggtgttgcattatacacttggttggaacatcctgaaggtgttgttggttactttgaagaaaactcttttgttgttgttccaggtcaaaaaaaagttgttggtttcgttgttcaagctgacgaaactgatggtgaatgggttcatgatgttactgttagatctttgtgggatttgaatgaaggtgagtaatga

SEQ ID NO: 64 - DNA, 2796 bp, Neosartorya fischeri
atgcacgttaaggctgaaactgttttggctttgttgactccaggtttgccatctgttgttggtcaacatgttgttgatttgtctggtgatggttggactttatcttctactgctttggatagaactgttccaggtcatttgccatctcaagttcatttggatttgtttgaagctggtgttattaacattaccgcttctatgattttgactttcgttggtttgttgatgccaattggtagaataccagctactagattgaaagcttgtgatttggaaaatttcgaatctacttggttggtttttgatggtttggatactttcactaccattactttctgtgatcaacatgttggttctactgataatcaattcagacaataccatttcgatgtttctcaaatcttgaaagaatgtaagcaagatccagttattagaatcaattttggttctgctccatctattgctaatgctattgctaaatctccagatgctgaagaatggccaccaggtgttcaaattactaatgaatacccaaacagatggtacattagaaaagaacaatctgattttggttgggattggggtccagcttttgctccagttggtccatggaaaccatcttatatcgttcaaaacaaccatgctgaattatacgttttgaacaccgatttggatttttacagacaaggtcaaatcaattatttgccaccagatcaatctcaaccatggatagttaatgcttctattgatattttgggtccagttccttggaaaccatcaatgtctattgaaatcaaagatgctgctactggttctgttttatcttctggtttgttgcaaaatgttactgtttctggtaattctattactggtactactactattgatggtgatgctccaaaattgtggtggccatctggtatgggtgaacaaaacttgtataacgttactgttactgttcaaaacgataagaaaaagtctttggctaaagttacaaagagaactggtttcagaactatcttcttgaatcaaagaaacattaccgatgatcaattggctcaaggtattgctccaggtgctaattggcattttgaaatcaatggtcatgctttttatgctaagggttccaatattattccaccagatgctttttggccaagagttactcaagctagaatggctagattatttgatgctgttactgctggtaatcaaaacatgttgagagtttgggcttctggtgcttacttgcatgattttatctatgatttggctgacgaaaaaggtattttgttgtggtctgaatttcaattttctgatgccttgtatccagttaatgatgcttttttggaaaatgttgctgctgaagttgtttacaatgttagaagagttaatcatcatccatctttggctttgtgggctggtggtaacgaaattgaatctttgatgttgccaatggttaagagagctgatccaactggttattctaaatacgttggtgaatacgaaaagttgtacatttctttgattttgcctttggtttacgaaaacactagatctattacttattctccatcttctactactgaaggttacttgtacgttaatttgtctgctccagttccaatggctgaaagatattctaacactactccaggttcttattatggtgataccgattactataactacgatacctctgtttcttttgattacaaccattatccagttggtagatttgctaatgaatttggttttcattctatgccatctttacaaacttggcaacaagctgttgatccagaggacttgcattttaactcttccgttgttatgttgagaaatcatcattatactgctggtggtttgtttactgataacttcaagaactcttctaaaggtatgggtgaaatgactatgggtgttgaagcttattatccaattccatctaagtctgattctgttgctaatttttctgcttggtgtcatgctactcaattatttcaagccgatatgtacaaatctcaaatccaattttacagaagaggttctggtatgccagaaagacaattgggttcattatattggcaattggaagatatttggcaagctccaacttgggctggtattgaatatgatggtagatggaaggttttacattatgttgctagagatatctaccaacctattatcgtttctccattttggaattatacaaccggtagattggaagtttatgttacttctgatttgtgggaaccagctcaaggtactgttaatttgacttgggttgatttgtcaggtaaaactattgctaacaatgctggtactccagaaactgttaattttactgttggtgctttgaacactactaatatctacactaccaacatttctgaattgtctttgccagatttgaaagattccattttgattttgtcattgtctggtgaaggtagattgccaaatacttcttctaaaaaggctttcgttcatcaaaatcattttactccagtttttccaaaagatttgtctttgaaggatccaaaattggaaatttcttactctccagaatctagaaagtttactgttcaagctactggtggtgtttcattatacacttggttggattatccagctggtgctgttggttattttgaagaaaacgcctttgttttgttgcctggtgttcaaaaagaagtttcttttgctgctcaagaaggtaacgttactgacgattgggttagaagagtaactgttcaatctttgtgggatcaaaaggttagagactaatga

SEQ ID NO: 65 - DNA, 2547 bp, Trichoderma reesei
atggtcatcagatctttgttgttgttgttattggctgctatagttccagtttttgctgaatctggtattgatgcttggttgagatatgctagattgccatcttctgctactagaggtcatttgacatcttttccagatagaatcgttgttttgaatgcttctaaaaatggtccattggcttcagcttcatctgaattgcataagggtatcaaaggtattttgggtttggatttggatgtttcttctagaggtggtaaacattgctctactcaaaagtctatcgttatttctactttggatacttatcaatctgcttgtggtaaattgtctccaaagttgaacttgaaagaagatggttattggttgtctacaaaaggtggttctgttcaaattattggtcaaaacgaaagaggtgcattatacggagcttttcaatacttgtcttatttgggtcaaggtgatttttctggtaaagcttttgcttctaatccatctgctccagttagatggtctaatcaatgggataatttgaatgctgctactgctgctcatggttctattgaaagaggttacggaggtccatctattttttttgaaaacggtttgatcaaagaagatttgtctagagttccattatatggtagattattggcttctgttggtttgaatggtatcgttatcaacaatgttaatgctgatgctaatttgttgaacgaaactaacttgcaaggtttgaaaagaattgctgatttgtttagaccatggggtgttaatgttggtatttctttgaattttgcttctccacaagttttgggtgatttgtctacttttgatccattggatgattctgttattaagtggtggactgataagactgatagaatctatcaattggttccagatttggctggttatttggttaaggctaattctgaaggtcaaccaggtccattgacttataatagaactttggctgaaggtgcaaatttgtttgctaaagctgttcaaccacatggtggtatagttgtttttagagcctttgtttacgatcaattgaacgaaacagattggaaagctgatagagctaatgctgctgttgatttttttaagtccttggatggtcaatttgatgataacgttttggttcaaatcaaatacggtccaattgattttcaagttagagaaccagcttctccattatttgctaatttgccaaaaactgctgtttctatcgaattggaagttactcaagaatacttgggtcaacaatctcatttggtttatttgccaccattgtggcaaactgttttgggttttgatatgagatacaacaacagacaatcttacgttagagatattatttctggtgaagtttttggtcataagttgggtggttatgctggtgttattaacgttggtatggatgatacttggttgggttctcatttggctatgtctaatatgtttgcttatggtagattggcttggaatccaagagctgattctagagatatagttgaagaatggactagattgacttttggtttggatagagatgttgtttctactattgctgatatgtctttgaaatcttggccagcttatgaaggttattctggtaatttgggtattcaaaccttgactgatatcttgtatactcattatggtgctaatccagcttctcaagataacaatggttggggtcaatggactagagctgattcaaaaactattggtatggatagaactgtttctaatggtactggtaatgctggtcaatatccaaaagaagttgctgctagatttgaacatactcaaactactccagatgatttgatgttgtggtttcatcatgttccatacacttttagattgcattctggtaagtctgttattcaacatttttacgatgctcattatactggtgctgctactgttcagagatttccagctgcttggaagtccctaaagtctaagattgatactgaaagatacaatgctgtcttgtacaaattgcaatatcaaactggtcattctttggtttggagagatgctattactgaattttacagaaacttgtcctctattccagatcaattgaatagagttagaaaccatccacatagaattgaagctgaagatatggatttgtctggttttactgttgttaatgtttctccaactgaatgtgcttctaagtacaaagctattgctactaatggtacaggtacagctactactagattgaatgttccatctggtaagtatactgttgctgttaattactacgatgttattaacggtactgcttcttatgatgttttgttgaacggtaaatctttgggtaaatggaaaggtgattctgaaactcatttgggtcatgatttttctacattcttggattgtcattctgctattagaattactttcgaaggtgttagaatttctagaggtgataagttgactattagaggtacaggtaatgctcaagaacaagctgctattgattacgtttctattttgccacaaggtgttgttgattgataa

SEQ ID NO: 66 - DNA, 2529 bp, Aspergillus niger
atgagaggtttgaatttgttccaattgattttggctttgttgttgtctatggttgctgctgaagatggttatgatggttggttgagatatgctccagtttcttgtgatttgagatgtagacaagctttgccatctcatgttgttttgttgaactctacaaaaggttctccaattgaaactgctggtagagaattgaaagctggtttccaatctattttgtctactaatttgacttctagaccatttcaatgtaactcttctacctctattttggttgctactttggatgagtatagacaaagatgcagagatattaacgttccagaattggatccagatggtttttggttgcaatctgaaggtgatactgttagaattttgggtaaagatgctagaggtgcattatatggtgcttatgaatatttggctatggttgctcaaagaaatttttctagagttgcttatgctacttctccacatgctccaattagatgggttaatcaatgggataatatggatggttctattgaaagaggttacggaggagcttctattttttttaaggatggtactgttgttgaagatatggctcctgttgaacaatatgctagattattggcctctattagaatcaatgctatcgttgttaacaatgttaatgctaacgctactttgttgttgccagaaaacatgaagggtttgggtagaattgctgatgcttgtagaccatatggtgttcaaattggtatttctttgaattttgcttctccagaagatttgggaggtttgaatacttatgatccattggatccaggtgttattgcttggtggcaaaacattactgattccttgtatacttatgttccagatatggctggttatttggttaaggctgattctgaaggtcaaccaggtccagatacttataatagaaccttgtctcaaggtgctaatttgtttgctagagctttacaaccatatggtggtgttttgatgtatagagctttcgtttacgatgataacttgaatgaatctgattggaaagctgatagagctaaagctgctgttgaatactttaaagatttggacggtcaatttgaagaaaacgttgtcattcaaatcaaatacggtccaatcgattttcaagttagagaacctacttctccattatttgctaacttgtaccatacaaacactgctattgaattggaagtttcccaagaatatttgggtcaacaatgtcatttggtttatttgccaccattgtggaaaactgttttggatttcgatttgagagttgatcataagccatctatggttagagatattatttctggtcaaagattcaatagaactttgggtggttgggctgctgttgttaatgttggtactaatagaacttggttgggttctcatttggctatgtctaacttgtatgcttatggtagattggcttggtcaccaactgatgaatctgaacaaattttggaagattggactagattgacttttggtcaaaaccatcatgttattaacaccatttctgatatgtctatgacttcttggccagcttacgaaaattatactggtaacttgggtattcaaactttgactgatatcttgtatactcattatggtccaaatccagctactcaagataacaatggttggggtcaatggactagagctgatcatgattctgttggtatggatagaactattagaaatggtactggttatactggtcaatatccagaagaagttgctagagtttacgaatctttggaatctactccagatgatttggttttgtggtttcatcatgttccatggactcatagattgcattctggtgttactgttattcaacatttctacaatgctcattatgctggtgctgaagctgctcatggttttgttagacaatgggaatctttagaaggtttgatcgatagagaaagatatgaagctatgagatctagattggtttatcaagctggtcattctatagtttggagagatgctattaacaatttctactacaacatgactggtattccagatgttgctggtagagttggtcatcatccttggagaattgaagctgaatctatgagattggatggttatcaaacttatactgtttctccatttgaagctgcttctaacactactgctattattactacttctaactctactactggtactgctagaacttctattaaggctccatctggtgtttatgatattggtgttaactattatgacttgtatggtggtcaatctaaatggactttgtctgttggtgataaggttgttggtcaatggttgggtgatatggaacataattctttgggtcatactccatctatctatttggatggtcattctgctactagaattacttttcatggtgttggtattagacaaggtgatcaattgaaaatcgttggtgaagctaatggtgttgaaccagctccattggattatatcgttttgttgccaccaggtttggttgattgataa

SEQ ID NO: 67 - DNA, 2517 bp, Talaromyces emersonii
atgatgaggaggctactattattattgtccgctggtttggttgctgctgaaaatggtttggatggttggttgagatatgctccattgccaggtgcttctagatacttgcatgatttgccatcttctatagttgctttgaatgcttctgaaacttctccagttttggttgctggtactgaattgagaagaggtttacaaggtattttcggtaaacatgtttctatttcccatcaagattgcaatgcttcatcttctatcgttgttggtactgttgatgaatactctaaattgtgtggttctactgctgctttgccagaattggatcaagatggttttttgttgaacactaagggtaatactgttcaaatttctgctgttacttctgctgttagatctatggctggtgcttttgaatatttgtctatgttggctcaaggtaatttttctcaagttgcttatgcttctaatccaagagcaccaattagatgggttaatcaatgggataatttggatggttctattgaaagaggttacggaggcgcttctattttttttgaaaacggttctgttgtttctaatttgactagagctgctcaatatgctagattattggcttctattggtgttaatgctgttgttgttaacaatgttaatgctaacgcttctattttgactgctgataacattgatggtttgggtagaattgctgatgtttttagaccatatggtgttcaattggctatttctttgaattttgcttccccaactattattggtggtttgaatacttttgatccattggatccatctgttattgcttggtggactaatgttactgataatttcactgctcatccagatatggctggttatccagttaaggctgattctgaaggtcaaccaggtccattgacttataatagaaccttggctaaagaaccaccattttttgctaaagttttacaaccacatggtggtatggttatgtttagagctttggtctacaatcaattgaatgaatctgattggaaagctgatagagctaaagctgctgttgatttttttcaaggtttggacggtcaatttgatgataatgttgtcgttcaaatcaaatatggtccaatcgattttcaagttagagaacctactccaccattatttgctcatttgagaaatacttctaccgctattgaattggaagttacccaagaatatttgggtcaacaatgtcatttggtttatttgccaccattattggaagatagaccatctgctttgacatctggtgttaatcaagaatctagaagattggttagaaacattattactggtcaaagattcaatagaactttgggtggtgctgctgctgttgttaatgttggtactaataccacttggttgggttctcatttggctatgtctaacttgtatgcttatggtagattggcttgggatccagcttctgatgctgaaagagttttacaagattggattagattgacttttggtcaagatagatctgttattgataccattacccaaatgtctatggaatcttggccagcttacgaaaattattctggtaacttgggtattcaaactttgactgatatcttgtacactcattttggtccaaatccagcttctcaagataacaatggttggggtcaatggactagagctgatcatacaactattggtatggatagaactgtttggaatggtactggttatactggtcaatatccaccagaagttgctgctatgtacgaaaacattgatacaactccagatgatttgttgttgtggtttcatcatgttaattacacccatagattgcattctggtaagactgttattcaacatttttacgatgctcattatagaggtgctgaaactgctcaaacttttttgactatgtgggaagctttgaaaggtaaaattgactctgaaagatacaatgatgttcatttcagattgacttatcaagctggtcattctatagtttggagagatgctattactaatttctacttcaacttgtctggtattccagatgaagctggtagagttgatcatcatccttggagagttgaagctgaatctatgactttgtctggttgtaaaacttatgctgtttctccatttgaaactgcttttaacactactgctatcgttacttctactaattctactgttggtactgctactacaaaattggattacagattgcatgttagaccaggtagagaattattgagacatgttagaggtcaagttcatttggctggtgttttaaatgatagaaagtctgctaatggttctggtaacaaagaagaacattttggtcatactccatctatctatttggatggtcattctgctactagaattacttttagaggtgttaagattggtaaaggtgatgaattgaaaatcgttggtactccagatggtgttgaaccagctccattggattatgttgctgttttgccaggtggtgttgttgattgataa

SEQ ID NO: 68 - DNA, 912 bp, Aspergillus niger
atgttgtctactcatttgttgtttttggctactactttgttgacttctttgtttcatccaattgctgctcatgttgctaaaagatctggttctttgcaacaaattactgattttggtgataatccaactggtgttggcatgtacatttacgttccaaacaatttggcttctaatccaggtattgttgttgctattcattattgtactggtactggtccaggttattactctaattctttctacgctactttgtctgaacaatacggtttcattgttatctatccatcttctccatattctggtggttgttgggatgtttcttcacaagctactttaactcataatggtggtggtaattctaattctattgctaacatggttacttggactatttctgaatatggtgctgattctaagaaagttttcgttactggttcttcttctggtgctatgatgactaatgttatggctgctacttatccagaattgtttgctgctggtactgtttattctggtgtttctgctggttgtttttactctgatacaaaccaagttgatggttggaactctacttgtgctcaaggtgatgttattactactccagaacattgggcttctattgctgaagcaatgtatccaggttattctggttctagaccaaaaatgcaaatttaccatggttctgttgatactactttgtacccacaaaattactacgaaacttgtaaacaatgggctggtgtttttggttatgattattctgctccagaatctactgaagctaatactccacaaactaattacgaaactactatttggggtgataatttgcaaggtatttttgctacaggtgttggtcatactgttccaattcatggtgataaagatatggaatggtttggttttgcatta

SEQ ID NO: 69 - DNA, 906 bp, Trichoderma reesei
atgccatctgttaaagaaactttgactttgttgttgtctcaagcttttttggctactggttctccagttgatggtgaaactgttgttaaaagacaatgtccagctattcatgtttttggtgctagagaaactactgtttctcaaggttatggttcttctgctactgttgttaacttggttattcaagctcatccaggtactacatctgaagctattgtttatccagcttgtggtggtcaagcttcttgtggtggtatttcttatgctaactctgttgttaatggtactaatgctgctgctgcagctattaacaatttccataactcttgtccagatactcaattggttttggttggttattctcaaggtgctcaaatttttgataatgctttgtgtggtggtggtgatccaggtgaaggtattactaatactgctgttccattgactgctggtgctgtttctgctgttaaagctgctattttcatgggtgatccaagaaatattcatggtttgccatataatgttggtacttgtactactcaaggttttgatgctagaccagctggttttgtttgtccatctgcttctaagattaagtcttattgtgatgctgctgatccatattgttgtactggtaatgatccaaatgttcatcaaggttacggtcaagaatatggtcaacaagctttggctttcattaattctcaattgtcatctggtggttctcaacctcctggtggtggtccaacttctacttctagaccaacttctacaagaactggttcttctccaggtccaactcaaactcattggggtcaatgcggtggtcaaggttggactggacctacccaatgtgaatctggtactacttgtcaagttatttctcaatggtactctcaatgctta

SEQ ID NO: 70 - DNA, 1107 bp, Neosartorya fischeri
atgagagctttgtctgttttttttgctttgttctgtttcttggctttatcttctgcttctccaggtcaagatgttgttaaaagagttacttctggttctttgcaacaagttactaattttggttctaatccatctggtactttgatgtacatttacgttccaaagaatttggctactaaaccaggtattgttgttgctattcattattgtactggtactgctcaagcttattatactggttctccatatgctcaattggctgaacaatacggttttattgttatctatccacaatctccatattctggtacttgttgggatgtttcttctcaatctgctttaactcataatggtggtggtgattctaattctattgctaacatggttacttggactatttctcaatacaatgctgatacttctaaggtttttgttactggttcttcttctggtgctatgatgactaatgttatggctgctacttatccagaattgtttgctgctgctactgtttattctggtgtttctgctggttgtttttactcttcatctaaccaagttgatgcttggaactcttcttgtgctcaaggtaatgttatttctactccagaagtttggggaggtattgctaaagcaatgtatccaggttatactggtccaagaccaagaatgcaaatttatcatggttctactgatactactttgtacccacaaaattactacgaaacttgtaaacaatgggctggtgtttttggttacaattacaactctccacaatctactcaatctaatactccacaagctaattaccaaactactatttggggtccaaatttgcaaggtatttttgctactggtgttggtcatactgttccaattcatggtgaacaagatatggaatggtttggttttgcaggtggttcttctactactactacacaaccaactactacttctactacaacatcttctggtggttcttcaactggtactggtgttgctgctcattggggtcaatgtggtggtaatggttggactggtccaactgtttgtgcttctggttatacttgtactgttgttaatgcttggtattctcaatgcttataa

SEQ ID NO: 71 - DNA, 1338 bp, Trichoderma reesei
atgaccccacattctattgatagagctgctagaccatctgtttggtctggtttggctttgttgttgtctactgctcatgctatagttatgccagatggtgttactggtaaagttccatctttgggttggaactcttggaatgcttatcattgcgatattgatgaatctaagtttttgtctgctgctgaagttatagtttcttctggtttgttggatgctggttacaattacgttaacattgatgattgctggtctatgaaggatggtagagttgatggtcatattgctgttaacactactagatttccagatggtattgatggtttggctaaaaaagttcatgatttgggtttgaaattgggtatctattctactgctggtactgctacttgtgctggttatccagcttctttgggttatgaagatgttgatgctgctgattttgctgattggggtgttgattatttgaaatacgataactgtaatgttccatctgattggcaagatgaatatgttgcttgtgctccagatgctgttcaaactggtccaaatggtacttgttctactgctttggaacctaatttggctccaccaggttatgattggtctacttctaaatctgctgaaagattcaatgctatgagaaatgctttggctaaacaatctagagaaattgtcttgtctttgtgtatttggggtgttgctgatgttttttcttggggtaacgaaactggtatttcttggagaatgtctggtgatatttctccagaatggggttctgttactcatattatcaatatgaactccttcaaaatgaactctgttggtttttggggtcataatgatgctgatattttggaagttggtaatggtaatttgacagctgctgaaactagaactcattttgctttgtgggctgctatgaagtctccattattgattggtactgatttggctcaattgtctcaagaaaacatcgaattattgaagaacaaacatttgttggctttcaatcaagattctgtttatggtcaaccagctactccatacaaatggggtgttaatccagattggacttttaattacactaatccagctgaatattgggctggtccatcttctaaaggtcatttggttttgatgatgaacactttggatcatactgttagaaaagaagctaagtggtctgaaattccaggtttgtctgctggtagatatgaagttagagatgtttggactgataagtctttgggttgtttgtcatcttacaaaactgctgttgctgctcatgatactgctgttattttggttggtaagaagtgtagaaattggtaatga

SEQ ID NO: 72 - DNA, 1500 bp, Aspergillus niger
atgttctcccgccgaaacctcgtcgccctagggctggctgccaccgtcagcgccggtccctgtgacatctacgaagccggggacacgccctgcgtcgcggggcacagcaccacccgcgcgctatacagctccttcagcggtgccctctaccaaatcaaacgaggctccgacgacaccaccaccaccatctcccccctgacagctggcggtgtcgccgatgcctccgcacaagacaccttctgcgccaacaccacctgcctgatcaccatcatctacgaccaaaccggtaacggcaaccacctcacccaggcccctcccggtgggttcgacgggcccgacaccgacggctacgacaacctcgcgccgacgatcggcgcccccgtcaccctgaacggccaaaaggcctacggtgtgttcatgtcccccggcacgggctaccgcaacaatgccgccacggggaccgccaccgggcacgaagccgaacggatgtacgccgtgctggacggcacgcactacaacgacgcgtgctgcttcgactacggcaactggcaaaccagcagcaccgacacgggcgccggccacatggaagccatctacttcggcaccagcaccacctggggctacggtgccggcgatgggccctggctcatggtcgacatggagaataacctcttctccggtgccgacgagggctacaactccggtgatccctcgatcccgtacaccttcctcactgctgcggtcaagggcggcgccgataagtgggcgattcgcgggggtaactctgcctcgggctcgctttctacttactacagtggcgtgcgcccagattactcgggctataaccccatgagcaaggagggcgctatcatcctgggtatcggcggtgataatagtaacggcgcgcaggggaccttctacgaaggtgtcatgacctccggatatccatcggatgctaccgagaactctgtgcaggagaacatcgtcgcggcgaaatatgccgttggctcgctggtcagtgggccgtcgttcacctctggggaggtggtctcgctgcgtgtgactacacccggttacacgacgaggtatatcgcgcacacggatacgacggtgaacacgcaggtcgtggatgatgatagtgactcttcgttgaaggaggaggccagttggacggtcgtgcacggtctggctaatagtcaatgcttctcgttcgagtcggtggatacccctggcagctatatccgccattataactttgcgttgttgttgaatgcgaatgatggcaccaagcagttccatgaggatgctacgttctgtcctcaggctgcgttgaatggggagggcacttcgttgcgctcgtggagttaccccacgcgctattttagacattatgagaatgtcctctatgctgcgagtaatggtggcgtgcagacgtttgattcgaccacgtcgtttaataatgatgtgagctttgagattgagacggcgtttgcttcgtaa

SEQ ID NO: 73 - DNA, 972 bp, Trichoderma reesei
atggaattgaaagctttgtctgctgttgttttgtcttttgttactttggttgctgctgctccagctacttgtactttgccatctacttatagatggaactctactggtgctttggcttctccaaaatctggttgggtttctttgaaagatttctcccatgttatctataatggtcaacatttggtttggggttctactcatgatactggtactatttggggttcaatgaattttggtttgttctctgattggtctaatatggctactgcttctcaaaacaaaatgactccaggtactgttgctccaactgttttttattttgccccaaagaatatttgggttttggcttatcaatggggtccaactactttttcttacttgacttcttctaatccatcttctgttaatggttggtcatctccacaaccattattttctggttctatttctggttcttctccattggatcaaactgttattggtgattctaccaatatgtacttgttttttgctggtgatgatggtaaaatctatagagcttctatgccaattggtaattttccaggttcttttggttctacttctacagttgttttatctgacgaaagaaacaatttgtttgaagccgttcaagtttacactgtttctggtcaaaaacaatacttgatgatcgttgaagctattggtgctaatggtagatactttagatcttttactgctactaatttgggtggtacttggactccacaagctacatctgaatctcaaccatttgctggtaaagctaattctggtgctacttggacaaatgatatttctcatggtgatttgattagatctaacccagatcaaactatgactattgatccatgtaacttgcaattcttgtatcaaggtagagctacaaattctggtggtgattatggtttgttgccatatagaccaggtttgttgactttacaaagataatga

SEQ ID NO: 74 - DNA, 1146 bp, Chaetomium globosum
atgaagttgtctaagtctgatttgtctgctgctttgttggcttctgctttgccagttgctcaagctgcttgttctttgccatcttcttacaaatggacttctactggtgctttggctcagcctagatctggttgggctaatttgaaagattttacctacgctccatacaatggtaaacatttggtttacgcttcatattttggtggtaattacggttctatgaattttggtttgttctctgattggtcatctatgggttctgcttctcaaaatcaaatgaactctgctactgttgctccaactttgttttattttgccccaaaaaaagtttgggttttggcttatcaatggggtgctactccattttcttatagaacatcttctgatccaactaatccaaatggttggtcatctgctcaaccattattttctggttctatttctggttctgatactggtccaattgatcaaactttgatttctgatggtacaaatatgtacttgtttttcgctggtgataatggtaaaatctacagatcttctatgccagttggtaattttccaggtaatttcggttcttcttctactgttattatgtctggtaacaagaatgatttgttcgaagctgttcaagtttacactgttgctggtcaatctcaaaaaacctacttgatgattattgaatctattggttctagaggtagatatttcagatcttacacctctaacaatttgggtggttcttggactccacaagctacatctgaaaatgctccatttgctggtaaagctaattctggtgcttcttggactaatgatatttctcatggtgatttgttgagaacttctgctgacgaaactatgactattgatccatgtaacttgcaattattataccaaggtagatctggtgattcttctgattataactctttgccatatagaccaggtttgttgactttacaaggtgctactggtggttctccaaacaatccagaacctactggtggtactaatccaggtacaggtggtactgttcctaaatatggtcaatgtggtggttctggttatacaggtccaactacttgtgcttctggttctaaatgtactttttccaacgaatggtattctcaatgtttgtgataa

SEQ ID NO: 75 - DNA, 1002 bp, Aspergillus niger
atgaagttcttgaaagctaaaggttctttgttatcttctggtatctatttgattgctttggctccatttgttaatgctaaatgtgctttgccatctacttattcttggacttctactgatgctttggctactccaaaatctggttggactgctttgaaagattttaccgatgttgtttctaacggtaaacatatcgtttatgcttctactactgatactcaaggtaattatggttctatgggttttggtgctttttctgattggtctgatatggcttctgcttctcaaactgctacttctttttctgctgttgctccaactttgttttactttcaacctaagtctatttgggttttggcttatcaatggggttcttctacttttacttacagaacttctcaagatccaactaatgttaatggttggtcatctgaacaagctttgtttactggtaaaatttctggttcttctacaggtgctattgatcaaactgttattggtgatgataccaatatgtacttgttttttgctggtgataatggtaaaatctacagatcttctatgtctattaacgattttccaggttcttttggttctcaatacgaagaaattttgtctggtgctactaatgatttgtttgaagccgttcaagtttacactgttgatggtggtgaaggtgattctaaatacttgatgatcgttgaagctattggttctactggtcatagatactttagatctttcactgcttcttcattgggtggtgaatggactgctcaagctgcttctgaagatcaaccatttgctggtaaagctaattctggtgctacatggactgatgatatttctcatggtgatttggttagaaacaatccagatcaaactatgactgttgatccatgtaacttgcaattattataccaaggtcatgatccaaattctaactctgattacaatttgttgccatggaaaccaggtgttttgactttgaaacaatgataa

SEQ ID NO: 76 - DNA, 1503 bp, Penicillium decumbens
atggcccaattgtcttttttgactttggctgttttgggtttgtctggtactgttgctgctcaatctgcttgtgcttctgcttgggctcaatgtggtggttctaattttaatggtccaacctgttgtgtttctggttcttcttgttctgttttgaacccatattactctcaatgtgttccaggtactcaagttccaggttctggttctggttcatcttctactagatcttcatctactactactgctggtggtactggtccatctactactgcaacagctggcggtggtgctgctggtacttctaagtatacaacttctacatcttttccagctgctactgctactcaaccagcttatccatctgctgatccatcttcatgtggtgcttggactttggttgataatgtttgttgtccagaatactgtttgtctaacaacaaatctgaatcttgtacttcttcatgttctggtggttgtggtactccaccatcttctatgtgtaaatctggtactatgtggggtgaacaattggaagttggtactgatgaagattggcattattctagatctactcattttggtttgacatctggtggtgcttgtggttttggcttgtatggtccatgtacaaaaggttctaaaactgcttcttggactgatccaatgttgggttctacttgtgatgctttctgtactgcttatcctttgttgtgtaaagatccatctgatgttactttgagaggtaattttgctgctccaaatggtgattattacactcaattttggccatctttgattggtgctttgccaggttctccagataattatttgtcttgtggtgaatgttttgaattgattagaactagagctgatggtactgaatatcaagttggtgattctggttatactgatccaatctacttggaagttgttgattcttgtccatgttctgctaattctaaatggtgttgtggttctggtgctgatcattgtggtgaaattgattttaaatacggttgtccattgcctgaaggttctcatcatatggatttgtctgatattgctatgggtagattgcaaggtaatggttctttgactgatggtgttattccaattagatacagaagagttccttgtccaaaaccaggtaatgcttatgtttggttgagagatggtggttctgaatattatttcgctttgtctgttgttaacactaatggtgttggttctattactactgttgaagttaagggtaaaggttctaattcttgggttgctttgaaaagagatccaaactatacttcttctagaccacaagaaagatatggtgcttgggttattccacaaggtaaaggtccattttctttgccagttggtattagagttacttctccagatggtcaacaaatagttaacgaaaacgctattacttcttttactgctccagctggttctgttgaaggtttttactacattgatttgggtgttcaattcacttaatga

SEQ ID NO: 77 - DNA, 1443 bp, Neosartorya fischeri
atgatgttgttgttgggcatttttttggcttggttggctgttgctgctgctcaatcttcttgtgtttctgcttggggtcaatgtggtggtatttcttatactggttctacttgttgtcaatctggtaatacttgtgctgaaatcaattcttactactaccaatgtactccagctactgctgtttctacttctactattactggtacttctccatcttctccaggttcttcatctgctaatacttcaggttataccactactactgtttttccatctccaactgctactcaaaatccatatccaccagctaatgcttcatcttgtggttcttgggctttggttgataatgtttgttgtccatattactgtttgtctaacaacgaatctgaatcttgtacttcttcttgtactggtggttgtggttctccagattcttctatgtgtaaatctggtactatgtggggtgaacaaggtactgttacttctaatgaagattggcattactctagatctactcattttggtttgacatctggtggtgcttgtggttttggcttgtatggtttgtgtactaagaactctgttactgcttcttggactgatccaatgttgggttctacatgtgatgctttctgtactgcttatcctttgttgtgtaaagatccagctaatgttactttgagaggtaattttgctgctccaaatggtgattattacactcaattttggccatctttggctgcttcaggtaatccagataattatttgtcttgtggtgaatgttttgaattgatcagaacaaaaccagatggtactgattatgctgttggtgaatctggttatactgatccaatagttttggaagttgttgattcttgtccatgtgatgctaattctaaatggtgttgtggttcaggtgctgatcattgtggtgaaattgattttaaatacggttgtccattgccagaaggttctcatcatatggatttgtctgatattgctatgggtagattgcaaggtaatggttctttgactgatggtgttattccaattagatacagaagagttccttgtccaaaaccaggtaatatctacatttggttgcatgatggtgctggtcaatattattttgctttgtctgctgttaacactaatggtccaggttctgttatttctattgaagttcaagctggtggttctggtccatggattgctttggaacatgatccaaattatacttcatctagaccacaagaaagatatggttcttgggttttaccacaaggtaaaggtccaattactgctccagttgctatgagattgactgctccagatggtcaacaagttgtaaaagaaggtgctattacttcttttactccaccagctacagctgttaagggtttttggtatattgatttgggtgttcaattcactagataatga

SEQ ID NO: 78 - DNA, 1455 bp, Talaromyces stipitatus
atggctaccactttgatttttgttatgggtttgtggtctggtttgttgtggtctactactgttgctcaagcttcttgtgctgctatttgggctcaatgtggtggttctggtttttctggtccatcttgttgtgaaactggttctacttgtactcaattgaactctttctactctcaatgtactccaactactcaaatttcttctgcttctccaactggtactaatccatcttctgttacatctttggttccatctggttcttcatatacttctaccacatctttgtctactgctactgctactcaagttccatatccagctgttaattcttcttcttgtggtgcttgggctttggttgaaaatgtttgttgtccatattactgtacttctaacaacgaatctgaatcttgtacttcttcttgttctggtggttgtggttctccagatgcttctatgtgtaaatctggtactatgtggggtgaacaaactactgttggtactgatgaatcttggcattattctagatctactcattttggtttgacatctggtggtgcatgtggttttggcttgtatggtttgtgtacaaaaggttcttctactgctaattggactgatccaatgttgggtgatacttgtaatgctttctgtactgcttatccattattgtgtagagatccatctaatgttactttgagaggtaattttgctgctccaaatggtgattattacactcaattttggccatctttggctgctgaaggtaatccagataattatttgtcttgtggtgaatgttttgaattgattagaactaaggctgatggtactgattatactgttggtgaagatggttatactgatccaatctacttggaaatagttgattcttgtccatgttctgctaatgctaaatggtgttgtggttcaggtgctgatcattgtggtgaaattgattttaaatacggttgtccaattccaaaagattctcatcatatggatttgtctgatattgctatgggtagattgcaaggtaatggttctttggctgatggtgttattccaattagatacaagagagttccttgtccaaaaccaggtaatgtttacatttggttgagagatggtgcaggtccatattatttttctttgtctgctgttaacactaatggtgttggttctgttattaacgttgaagttcaaggttctggtcaaactggttggactgctttggaaagagatccaaattattcttcatctagaccacaagaaagatatggtgcttgggttgttccacaaggtgctggcccttttaatgttccaattggtattagaattacttctccagatggtcaacaaatagttaacaccgaaatgattacatcttttactgctccagcttctgctccatctggtttttggtatattgatatgggtgttcaattcacttgatga

SEQ ID NO: 79 - DNA, 1491 bp, Trichoderma reesei
atgagattcccatctatttttactgctgttttgtttgctgcttcttcgagtctagctcaacaaaattgtgctgctttgtttggtcaatgtggtggtattggttggtctggtactacttgttgtgttgctggtgctcaatgttcttttgttaacgattggtactctcaatgtttggctagcactggtggtaatccaccaaatggtactacttcatcttctttggtttctagaacttcttctgcttcttcatctgttggttcttcatctccaggtggtaattctccaactggttctgcttctacttatactactactgatactgcttacgtagctccacattctcaatctccatatccatctattgctgcttcatcttgtggttcatggactttggttgataatgtttgttgtccatcttattgtgctaatgatgatacttctgaatcttgttctggttgtggtacttgtactactccaccatctgctgattgtaaatctggtacaatgtatccagaagttcatcacgtttcttctaatgaatcttggcattactctagatctactcattttggtttgacatctggtggtgcttgtggttttggtttgtatggtttgtgtactaaaggttctgttactgcttcttggactgatccaatgttgggtgctacttgtgatgctttttgtactgcttatccattgttgtgtaaagatccaactggtactacattgagaggtaattttgctgctccaaatggtgattattacactcaattctggtcatctttgccaggtgctttggataattacttgtcttgtggtgaatgtattgaattgattcaaactaaaccagatggtactgattatgctgttggtgaagctggttatactgatccaattactttggaaattgttgattcttgtccatgttctgctaattctaaatggtgttgtggtccaggtgctgatcattgtggtgaaattgattttaagtacggttgtccattgccagctgattctattcatttggatttgtctgatattgctatgggtagattgcaaggtaatggttctttgactaatggtgttattccaacaagataccgtagagttcaatgtccaaaagttggtaatgcttacatttggttgagaaatggtggtggtccatattactttgctttgactgctgttaatactaatggtccaggttcagttactaagattgaaattaagggtgctgatactgataattgggttgctttggttcatgatccaaattatacatcttctagaccacaagaaagatatggttcttgggttattccacaaggttctggtccatttaacttgccagttggtattagattgacttctccaacaggtgaacaaattgttaacgaacaagctattaagacttttactccacctgctactggtgatccaaatttctactacattgatattggtgttcaattctctcaaaacttataatga

SEQ ID NO: 80 - DNA, 954 bp, Trichoderma reesei
atggttagaagaactgctttgttggctttgggtgctttgtctactttatctatggctcaaatttctgatgattttgaatctggttgggatcaaacaaaatggccaatttctgctccagattgcaatcaaggtggtactgtttctttggatacaactgttgctcattctggttctaattctatgaaggttgttggtggtccaaatggttattgtggtcatattttctttggtactactcaagttccaactggtgatgtttatgttagagcttggattagattgcaaactgctttgggttctaatcatgttaccttcattattatgccagatactgctcaaggtggtaaacatttgagaattggtggtcaatctcaagttttggattacaacagagaatctgatgatgctactttgccagatttgtctccaaatggtattgcttctactgttactttgccaactggtgcttttcaatgttttgaataccatttgggtactgatggtactattgaaacttggttgaacggttctttgattccaggtatgactgttggtccaggtgttgataatccaaatgatgctggttggactagagcttcttatattccagaaattaccggtgttaattttggttgggaagcttattctggtgatgttaatactgtttggttcgatgatatttctattgcttcaactagagttggttgtggtccaggttctccaggtggtcctggttcttctactactggtagatcttctacttctggtccaacttctacatctagaccatctactactattccaccaccaacttctagaactactactgctactggtccaactcaaactcattatggtcaatgtggtggtattggttattctggtcctactgtttgtgcttctggtactacttgtcaagttttgaacccatattactctcaatgtttgtgataa

SEQ ID NO: 81 - DNA, 930 bp, Chaetomium globosum
atgttgagacaaactgctttgttggctttggctttggttccagctacttttgctcaagttgctgaagattttgaaggttgggatcaaactgcttggccaatctatgctccagattgcaatcaaggtggtaaagtttctttggattctactactgctcattctggtaaaaactccattagagttgatggtgctggcggttattgtggtcatgttttctttggtacaaacaaagttccatctggtgatttttatgttagaacctacttgaaagcttctaaagctttgacttcttctcatgtttctttcattactatgccagatccagctcaaggtacaaacaagcacttgagaattggtggtcaaaattccattttgatgtacaacagagaatctgatgatgctactttgccagatttgtctccacaaggtgttgctgcttctactgctttgccaactggttcttggcaatgttttgaatatcatgttggttctgatggttctattgaaacttggttgaatggtcaagctattgctggtttgacttctattccaggtcaatctaatccaaatgctggtcaatggcaaagatcttctattaagccaaaaccatctgctgtttattttggttgggaatcttatggtggtgatacaaatactttttggtacgatgatattgtcatttcttcatctagagttggttgttctggtggtactaatccaccagcttctactactttggttacttctgttactccaggtccatcttctactgctacatctttagctccagctacttctactacatcttctggttgtgctgctgctcaatggtcacaatgtggtggtattggttttaatggttgtactacttgtgcttctccatacacttgtaagttttccaatgattactactctcaatgtttgtgatga

SEQ ID NO: 82 - DNA, 951 bp, Magnaporthe grisea
atgttgagaaacattactttggctttggctgctgttttgccatttgctatgggtcaagtttctgaaggttttgaagctggtttggatgctactgcttggccaacttatgctccagattgctctcaaggtggtaaaattactttggattcttctcaagctcatactggtaaaaattccgttagagttgatggtgctggtggttattgtggtcatattttctttggtactactaaggttccatctggtgatgtttatgttagaacttggttgaaagcttctagagctttgactgatgctcatgttacttttattactatgccagatactgctcaaggtgctaaaaaacatttgagagttggtggtcaatctaagattttgatgttcaacagagaaactgatgatgctactttgccagatttgtctccacaaggtattgctacatctgctgctttgccagctaattcttggcaatgtttggaatatcatttgggtccagatggtactttggaaacatggttgaatgataaggctgttgctggtttgacttctaaagctggtgttgctaatccaaatgctgctcaatggcaaagatcttctattaagccaaaagtttctggtgtttattttggttgggaatcttatggtggtgatgctaatactttttggtatgatgatgttgctatttcttcacaaagagttggttgcggtaacgctactgttgttgaagcttattcttctactactggtagatcttctacttctggtccaacttctacatctagaccatctactactattccaccaccaacttctagaactactactgctactggtccaactcaaactcattatggtcaatgtggtggtattggttattctggtcctactgtttgtgcttctggtactacttgtcaagttttgaacccatattactctcaatgtttgtgataa

SEQ ID NO: 83 - DNA, 1386 bp, Trichoderma reesei
atggcctctagattttttgctttgttgttgttggctattccaattcaagctcaatctccagtttggggtcaatgtggtggtattggttggtctggtccaactacttgtgttggtggtgctacttgtgtttcttacaacccatattactctcaatgtattccatctactcaagcttcatcttctattgcttctactactttggttacttctttcactactactactgctactagaacttctgcttctactccaccagcttcatctactggtgctggtggtgcaacatgttctgctttgccaggttctattactttgagatctaacgctaagttgaatgatttgttcactatgtttaacggtgataaggttactacaaaggataagttctcttgtagacaagctgaaatgtctgaattgatccaaagatatgaattgggtactttgccaggtagaccatctactttgactgcttcattttctggtaacactttgactattaactgtggtgaagctggtaaatctatttctttcaccgttactattacttatccatcttctggtactgctccatatccagctattattggttatggtggtggttctttgccagctccagctggtgttgctatgattaacttcaacaacgataatattgctgctcaagttaatactggttctagaggtcaaggtaaattttatgacttgtacggttcttctcattctgctggtgctatgactgcttgggcttggggtgtttctagagttattgatgctttggaattggttccaggtgctagaattgatacaactaagattggtgttactggttgttctagaaatggtaaaggtgctatggttgctggtgcttttgaaaaaagaattgtcttgactttgccacaagaatctggtgccggtggttctgcttgttggagaatttctgattacttgaaatctcaaggtgctaatattcaaactgcctccgaaattattggtgaagatccatggttttctactacctttaactcctacgttaatcaagttccagttttgccatttgatcatcattctttggctgctttgattgctccaagaggtttgttcgtcatcgataacaacattgattggttgggtccacaatcttgttttggttgtatgactgctgctcatatggcttggcaagctttgggtgtttctgatcatatgggttattctcaaattggtgctcatgctcattgtgcttttccatctaatcaacaatctcaattgactgcttttgttcaaaaattcttgttgggtcaatctactaatactgctattttccaatctgatttctctgctaatcaatctcaatggattgattggactactccaactttgtcttaatga

SEQ ID NO: 84 - DNA, 1428 bp, Chaetomium globosum
atgttgtctccagctttggcttcttctttgttggttgttttgggtgctgctggtgctcatgctcaacaaagacaagctttgtggggtcaatgtggtggttctggttggaatggtccaactgcttgtgttgatggtgcttactgttttcaacaaaatcaatggtatcatcaatgtattccaggttctgatagatctccatctccaactaatccaccacaacaatcttctactttgactacttctagagttactgttgctccaccaacttctacttctccagctccaggtggtggtggtactacttgtccagctactccatctggtcaaggttctccagttgctaatgctttgaatgatccattcacttttcatggtggtggtaaagtttcttctaaagctgattggacttgtagacaagctgaaatttctaagttgttgcaacaatatgaattgggtactttgccaccaaaaccatcttcagttactgcttcattttctggttctaccttgtctatttctgtttctgaaggtggtaagtctatttctttctctgtttccattaacaatagaccatcttcttcaggtccacatccagctattattaactttggtacttttggtggtttgccagttccagctggtgttgctactattaacttcaacaacgacgaaattgctcaacaacaagatcaatcttctagaggtaaaggtaaattctatgatatctacggttctggtcattctgctggtgctttgactgcttgggcttggggtgtttctagaattattgatgctttggaattgactagagcccaaactaatattgatccagctagaattggtgttactggttgttctagaaatggtaaaggtgctatggttgctggtgcattggaacctagaattgctttgactttgccagaagaatctggagctggcggttcaggttgttggagaattgctacttggcaaaagaatagaggtgaaaacgttcaagaatctaagcaaatcgttactgaaaatgtttggttttctaccaatttcaactctcaagttaacaatgttaatgctttgccatttgatcatcatatgttggctggtttgattgctccaagagcattatatgttatggaaaacactgatatggaatggttgggtaaagtttcaacttatggttgtatgggtattgctagaaaacaatgggaagctttgggtgctttggattcttttggttattctcaagttggtggtaattctcattgctcttttccatcttctcaacaaggttctgaattgaatgcttttatcggtaaatacttgttgaacaatccaaatgctggtaacactaacatttttagatctaccggtaatcaaaatttcgatttgaactcttggtcaccatggactgttccaaaattgtcttaatga

SEQ ID NO: 85 - DNA, 1176 bp, Aspergillus fumigatus
atgttcttgtacccagttttgttgtctttgatttcttctggtgctttggctgctacttgtccatctttgccatcttctccacaattgcaatctattactactttgccagatccattttcttggtatccattgcaaaaaactggtagagtttctactttgtctgattggcaatgtagacaatctcatatttcatccttgttgcaacaattggaattgggtacaaaaccaccagctccatcttcagttacttctactttctcccaaaacaaattgactattactgctactaatgctggtaacactatttctttcactgctactattacttatccatcttctggtgaaggtccatatccagctatgattgcttatggtggtttgtctattccattgccaccaggtgttgctgctattacttttgataactcccaaattgctcaacaaaatgatcaatcttctagaggtcaaggtttgttttacacattatacggtgctaatcattctgctggtgctttaatggcttgggcttgggctacttctttgattattgatagattggaagctactccagctgctagaatcaatacttctagaattggtgttactggttgttctagaaatggtaaaggtgctttggttgctggtgcatttgattctagaattgctttgactgttccacaagaatctggtactggtggttctggttgttggagattggctgctgcttctgaaggtgctccacaaaatgttcaaactgctggtgaaatagttcaagaaaacgtttggttttctactgcttttaatgcttacgctaacgatgaagatagattgccatttgatcatcatatgttggctggtttgattgctccaagaggtttgttatctattgataacgctggttatcaatggttgggtccatggtcatctttgggttgtatgggtactgctagattggtttggcaagctatgggtgttccagatagaatgggttattctatgtctactaatcatccacactgttcatttccagatcaacaaagagaagatttgttcgctttcattaacagatttttgttgggtatggaagttaacactactgttcaaaaaaattacgctggtattgcttttgattctaagccatgggttaattggcaagttccaaacttgacttaatga

SEQ ID NO: 86 - DNA, 1488 bp, Populus alba
atggctaacgctactactttttctttgatgttgcaattcttctttgttactttctgttgtttgtcttacttttctttcgctttcacttctcaagattatgctaatgctttggaaaagccaattttgtttttcgaaggtcaaagatctggtaaattgccatctaatcaaagattggcttggagaggtgattctggtttgtctgatggttctacttatcatgttaatttggttggtggttattatgatgctggtgataatgttaagtttggtttgccaatggcttttactactactttgttggcttggtctgttattgaatttggttcttccatgcaaaatcaaattgaaaatgctaaggctgctattagatggtctactgattatttgttgaaagctgctactgctactccagataccttgtatgttcaagttggtaatccaaatatggatcatagatgttgggaaagaccagaagatatggatactccaagaaatgtttacaaggttaccattcataatccaggttctgatgttgctgctgaaactgctgctgctttggctgctgcttctatagttttcaaagaatctgatccatcttattctactaagttgttgcatactgctatgaaggtttttgatttcgctgatagatatagaggttcttactctaattctttgaactcagttgtttgtccattttactgttcttattccggttatcaagatgaattattgtggggtgcttcttggattcatagagcttctcaaaatggttcttacttgacctacattcaatctaatggtcatacaatgggttctgatgatgatgattactctttttcatgggatgacaaaagaccaggtacaaaaattttgttgtccaaagaatttttggaaaagaccaccgaagaatttcaattatacaagtctcattccgataattacatttgttctttgattccaggtacttcttcatttcaagctcagtatactccaggtggtttgttttacaaagcttctgaatctaacttgcaatacgttacttctactactttcttgttgttgacttacgctaaatatttgggttctaatggtggtgttgctagatgtggtggttctactgttactactgaatctttgattgctcaagctaaaaaacaagttgattacatcttgggtgataatccagctagaatgtcttatatggttggttttggtaatagatatccacaacatgttcatcatagaggttcatctgttccatctattcatgctcatccaaacagaatttcttgtaacgatggttttcaattcttgtattcttcttctccaaatccaaatgttttggttggtgctattattggtggtccagataatagagataatttcgccgatgatagaaacaattaccaacaatctgaaccagctacttatattaacgctccatttgttggtgctttggcttttttttctgccaaaaactgatga

SEQ ID NO: 87 - DNA, 762 bp, Vitis lubrusca
atggctactgctgctttttcttctatttctttggctttgttcttgttttgtttgtgtttacaaggtactaatggtgattatggtggttgggaaggtggtcatgctactttttatggtggtggtgatgcttctggtactatgggtggtgcttgtggttatggtaacttgtattctcaaggttatggtactaatactgctgcattgtctactgctttgtttaattctggtttgtcttgtggtgcttgttacgaaatgaagtgtaatgatgatccaaaatggtgtttgccaggtactttgactgttactgctactaatttttgtccaccaaatttggctttgtctaacactaatggtggttggtgtaatccaccattgcaacattttgatttggctgaaccagcttttttacaaattgctcaatacccatcttggaatagaacttgtgtttttcaaagagttccttgcgttaagaaaggtggtattagattcactattaacggtcattcttactttaacttggttttgattactaatgttgctggtgctggtgatgttagagctgtttctattaagggttctaaaactggttggcaacctatgtctagaaattggggtcaaaattggcaatctaactcttatttgaacggtcaaactttgtcttttcaagttactgcttctgatggtagaactatgacttctttgaatgttgctccagctggttggcaatttggtcaaacttatgaaggtgctcaattctaatga

SEQ ID NO: 88 - DNA, 798 bp, Triticum aestivum
atggctccattatcttctaaagctgttgctttggttgctttattttctttgttggttacttatgctgctggtgctggtaattttaatgattctgcttttactgctgatccaaattgggaagatgctagagctacttggtatggtgctccaactggtgcaggtccagatgatgatggtggtgcttgtggttttaaaaacaccaatcaatacccattttcttctatgacatcttgtggtaatgaacctatttttaaggatggtaaaggttgtggttcttgttatcaaattagatgcaccaatgatcaatcttgttctggtaatccagaaactgttgttattaccgatatgaattattacccagttgctaaataccattttgatttgtctggtactgcttttggtgctatggctaaaccaggtttgtctgaaaaattgagacattctggtattattgacatccaattcaaaagagttccttgcgaatttccaggtttgaaagttactttccatgttgaacaaggttctaatccagtttatttcgctgttttggttgaatatgaagatggtgatggtgatgttgttcaagttgatttgatggaagctaattctggtacttggactccaatgagagaatcttggggttctatttggagattggattctggtcatagattgcaagctccattttctatgagaattaccaatgaatctggtaaatctttggttgctgataaggttattccagctaattgggctccatctactttttacagatccatcgttcaatactcttaatga

SEQ ID NO: 89 - DNA, 693 bp, Eucalyptus globulus
atggccaagaagttgtttattactgctgctttggctgctgctgttttagctgctccatgtggttatggttctggtgttgctcaagctccattttcttctatggtttctgctggtggtccatctttgtttaaatctggtaaaggttgtggtgcttgttatcaagttaagtgtactgaaaatgctgcttgttctggtaatccagttactgttgttattactgatgaatgtccaggtggtccatgtgttgctgaatctgctcattttgatttgtctggtactgcttttggtgctatggcttcttctggtaaagctgatgaattgagaaatgctggtgttttacaaattcaataccaaaaggttaagtgtaattttccaggtgctaaagttgcttttcatgttgattctggttctaatccaaattatttcgctgctttgattgaatatgaagatggtgatggtgaattgggtgctgttaatttgaaacaagctttggattctgattcttggttgccaatgcaacaatcttggggtgctgtttggaaattggacggtgctggtcaattgagagcaccattttctattaagttgacctctttggattcaggtaaaactttggttgctaacaatgttattccagctggttggcaacctggtcaaacttatagatctgttgttaacttcgctgtttaatga

SEQ ID NO: 90 - DNA, 849 bp, Aspergillus niger
atgaagcaattctctgctaaatatgccttgattttgttggctactgctggtcaagctttggctgcttctactcaaggtatttctgaggacttgtacaacagattggttgaaatggctactatttctcaagctgcttatgctgatttgtgtaacattccatccactattattaagggtgaaaagatctataatgcccaaactgatattaacggttggattttgagagatgatacctctaaagaaattatcactgtttttagaggtactggttctgatacaaacttgcaattggataccaattatactttgactccatttgatactttgccacaatgtaatgattgtgaagttcatggtggttattatattggttggatttccgttcaagatcaagttgaatctttggttaagcaacaagcttctcaatatccagattatgctttgactgttactggtcattctttaggtgcttctatggctgctttgactgctgctcaattgtctgctacttacgataatgttagattatacacttttggtgaacctagatctggtaatcaagcttttgcttcttatatgaacgatgctttccaagtttcttctcctgaaactactcaatacttcagagttactcattctaatgatggtattccaaatttgccaccagctgaacaaggttatgctcatggtggtgttgaatattggtctgttgatccatattctgctcaaaacacttttgtctgtactggtgatgaagttcaatgttgtgaagcacaaggtggtcaaggtgttaatgatgctcatacaacttattttggtatgacttctggtgcttgtacttggtaatga

SEQ ID NO: 91 - DNA, 1020 bp, Aspergillus terreus
atgaagggtgctatgttgttggctttttctttgactgctgttgctcaacaaacattatatggtcaatgtggtggttctggttggtctggtccaactcaatgtgtttctggtgcttgttgtatgtctcaaaatccatggtattctcaatgtttacaaggtaactgtatgactactacttctgtttctactactagaacaacatctgtttctgttactactacaacttctactggttcttctccatcttctacttcagtttctcaaggttgtggtaaatctccaactttatcttctggtactcatacaatgactgttaatggtgctactagacagtatattttgactttgccacaaggttatgattcttctagaccatacaagttgatttttggttatcattggttgtctggtactatgcaaaatgttgtttctggtaattattatggtgttcaaccattggctggtaattctgctatttttgttgctccacaaggtaaaaacaatggttgggctaattctggtggtgaagatattactttcaccgatcaaatgttgtctactttacaaggtgatttgtgtattgataagactcaaatctattctatgggttggtcttatggtggttctatgtcttatgctttggcttgtgctagaccaaatgtttttagaggtgttgctgttatgtctggtgctaatttgtctggttgttctccaggtactcaaccagttgcttattatgctcaacatggtgtttctgatactgttttgtctatttctttgggtagacaaattagagataccttcgttaaggataatggttgtacagctcaaaatccacctgagccagctgctggttcaggtacacatattaagtctgtttactctggttgttcatctggtcatccagtttggtggattccatttgatggtccacatgaaccattggctactgatagaggtgcttcttcttcttggactcctggtcaaatttgggatttcatttcccaattctcttaatga

SEQ ID NO: 92 - DNA, 1080 bp, Talaromyces stipitatus
atggccattccattggttttgttgttggcttggttgttgccaactgtttttgctgcttctttgactcaagtttctaattttggtgataatccaggttctttacaaatgtatatctacgttccaaacaatttggcttctaagccagctattatagttgctatgcatccatgtggtggttctgctactcaatattatggtatgtacgattatcatactccagctgatcaatatggttacattttgatctatccatctgctactagagatttgaattgctttgatgctgatacagctgcttctttaacacataatggtggttctgattctttgtctatcgttaacatggttaagtacaccatttctaaatatggtgctgattcttctaaagtttacatgactggttcttcatctggtgctattatgactaatgttttggctggtacttatccagatgttttcgctgctggtgctgctttttctggtatgccatttgcttgtttgtctggtgctggtggtgctgatccagctatgtctaatcaaacttgttctagaggtcaaatcaatcatactccacaagaatgggctgcttatgttcataatgcttatccaggttatactggtcaatatccaagattgcaagtttggcatggtactgctgataatgttatttcttacaccgacttcaatcaagaaatttctcaatggactactgttatgggtttgtctttcacttctaatcaaacaaatactccattgtctggttacacaaaaatgatatacggtgatggttctagatttcaagctttttctgcttctggtgttggtcattttgttccaactgatgtttctgttgttttggattggtttggtattactggtggtggcggtggtaatggtggtggttcaggttctactactactacaacttctgctactactacttctactggtccaactggtggttgtactgctgctcattgggatcaatgtggtggtaacggttatacaggttgtacttcttgtgcttctccatatacttgtcaaaaggttaacgattactactctcaatgtttgtgatga

SEQ ID NO: 93 - DNA, 1068 bp, Chaetomium globosum
atgttcttgagaacttttttgggtttggctgctactgctgctacaggtttagctgcttctttacaacaagttaattcttttggtgctaacccaactaatattcaaatgttcatctacgttccagataaggttgctgctaatccagctattatagttgctttacatccatgtggtggttctggtcaacaatggttttctggtactagattgccatcttatgctgattctaacggttttattatcgtttatccatctactccacatatgtctaactgttgggatgttcaaaatccagattctttgactcatggtcaaggtggtgatgctggtggtattatttctatggttaactacactttggaaaagtattctggtgatagagatagagtttacgttatgggtttttcttctggtggtatgatgactaatgttatggctggttcttatccagatgtttttgaagctggtgctgcttattctggtgttgcttttggttgttttcaaggtgctccatctgctactccaatgtctccaaatcaaacttgtgctcaaggtatgcaaaaaactccacaagaatggggtaatttggttagaaatgcttatccaggttatactggtagaaggccaagaatgcaaattactcatggtttggctgatggtttggttagaccaacttgtggtgaagaagctttgaaacaatggtctaatgttttgggtgttgagtacactagagatgttgctggtgttccatcttctggttggactcaaaaattatatggtggtgatggtgttaaggttcaaggttttatgggtcaaggtgttggtcatgctccatctgttaatgaagaacaattattgacctggtttggtattttgggtggtggtgaaaatggtggtggagaaaacggcggtggtaacaatggtggaggtaacaacggtggtggtggcggaggtactgttgctttgtggggtcaatgtggtggtaatggttattctggtccaactggttgtgcacaaggtacttgtaaagttttgaacgaatggtattctcaatgtactccataatga

SEQ ID NO: 94 - DNA, 2223 bp, Streptomyces avermitilis
atgacacaccgaaccggccgagcaccggaacacgggccgagaccgggccgtcgacggcgccggacgacctcggtcgccgcggcgctcgtcaccctggcgctgggcctggcagggcagctggccgggcatccggcggccgccgccgaagcccacgccgacaacccgttcgccggagcgagcttctacgtcaaccccgactacaccgacctcgtcggcacctcggcggcgcagacctcggacgccacgctcaaggccaggatgcagaaggtggggacctatcccaccgcggtgtggctcgaccgcatcgccgccatcacgggcggtgccgccaacgccggacgcaagagcctcgccgaccacctcgacctggccctggcccagaagaagcccggtcagccgatcaccgccacgttcgtggtctacgacctgcccggccgggactgctcggcgctcgcctccaacggcgaactcccgctgacccaagcggggttggaccgctacaagagcgagtacgtcgacgccatcgcgaacgtcttcaagaacccgaagtaccgtgacatccgcatcacgacggtcatcgagccggacggcctgcccaacctcgtgaccaacaccgccgacccggagtgcgcccaggccaagagcagcggcatctacgtcaagggcatccagtacgccctcgacagactgcacgccatccccaacgtctacacgtacctggacttcgcgcactccggctggctcggctgggacaacaacctttcccagaccgtgcagctctacaccgatgtcgccaagggcaccgcggccggattctccagtgccgacgggctgatcacccacgtctccaactacacgccgctcgaagagccgttcctgaccgatcccgacaagaccgtcggcgggaacatggtcaagtccagcaagttctacgagtggaaccccaacttcgacgagtcggacttcaccgggaacgtccaccgggcgctcgtcgcggccggctggcccgcttcgacgggcatggtgatcgacacctcccgcaacgggtggggcggcaccggacgccccaccacggagagcagcagcaccaccctcgacacctacgtcaatgagtcccgcgtcgaccgacgggcacaccgaggcctgtggtgcaacgtcagcggcgccggactcgggcagcccccgcaggctgcgccctccggctcccctgactcccacctcgacgcattcctgtggatcaagccgccgggtgagtcggacggcgccagctccgacattcccaacgacgagggcaagcgcatggaccccatgtgcgacccgacatacacggcgcccaacgcgggcggcaacaagaccggcgcgctgccgaacgcgcccctggcgggccactggttcgccgagcagttcgcgatgctggtgaggaacgcctacccggccgtgctcacggacggtggcggcaccccgggcggtgacaccaccgcgccgaccgcaccgaccggcctgaaggccaccgcgaagacgccgtccagcgtctccctgtcctggacggcgtccaccgacgacacgggcgtgagcgggtacgacctctaccgcggcggcacgaaggtcacggcctcgccggtggccggcacagcgttcacggacacggggctcagcgcgggcaccgcgtacagctacaccgtccgcgcccgtgacgccgccgggaacgtctcggcgccttccgcctcgctgagcgtcaccaccgacacgtccggcggcacaccggacccctcgggcggcctcaaggtcctctacaagaacaacgactcctcggccaccgacaacgccatccggccaggccttcggatcgtcaacaccggcagcggctccctcgacctgtccaaggtcacggcccgctactacttcacccgggacagcggctcgcccaccgtgaacgcctggtgcgactacgcggccgtcggctgttccaacgtcagcctgaaggtcgtacccctgaccacgcccgtgccgggagccgacgcctacctcgaagtcggcttcaccggcggcaccctggccgtcggccagaacaccggcgacctgcaactgcggatgagcaagtccgactggtcgaacttcgacgaggtcggcgactacagccgcggcacctccactacgtacaccgaagccgcagcgatccccgcgtatctcagtgccacgcccgcctggggagccccgcccgcc

SEQ ID NO: 95 - DNA, 1707 bp, Streptomyces avermitilis
atgagccgtaccagaacagcgatactcgctgccttggcgctggtcgccggggcctcggggaccgcggtcgccgcggtcgccccggaacccggcatcgccgccgtcccctgcaccgtcgactacaaggtgcagaaccagtgggacaccggtttcaccaccgccgtcacggtcaccaacaacggggccgccaagtcctcctgggccgtgaaatggtcgtacgccggaaaccagaaggtcaccagcggctggaacgccaggatcagccagagcggcacagccgtcaccgccgccaatgagagctacaacggggcgctggcgagcggcggttcggtcagcttcggcttcaacgcctcgtacagcggcaccaacgcactgccgaccgccttcacgctcgacggcgtgacctgcaacgtcgacgacggcggcggaggcgggggcggcacggacccggacccgtccggcaaggtcgacaacccctacgcaggcgccaaggtgtacgtgaacccggagtggtccgcgaaggccgcggccgagaccggcggcagccgcatctccagccagcccaccggcgtctggctcgaccgcatcgccgcgatcaacggcgtgaacggcggcatgggcctgcgcgcccacctcgacgcggccctcgcccagaagggcagcggcgaagaggtcgtccaactggtcgtctacgacctgcccggccgtgactgcgcggccctcgcctccaacggcgaactcggcccgacggagatcgacaagtacaagacgcagttcatcgacccgatcgcggcgatcctcgcggacagcaagtacgcgggtctgcggatcgtcacgaccatcgagatcgactcactgccgaacctcgtcaccaacaccggcagccgcgccaccgccacgcccgcgtgcgacacgatgctcgccaacggcaactatgtgaagggcgtcggctacgcgctgaacaagctcggcgcgatcccgaacgtctacaactacctcgacgccggacaccacggctggatcggctgggacgacaacttcgccccgtccgccaccctgttcaagcaggcggcgacgagtgagggcgcgacggtcgacgacgtgcacggcttcatcaccaacacggcgaactacagcgccctgaaggagaacaacttcaccatcaacgactcggtgaacggcacctccgtccgccagtccaagtgggtcgactggaaccgctacgtcgacgagctgtccttcgcccaggccttccgcacccagctcgtctcggtcggcttcaactccggcatcggcatgctgatcgacacctccaggaacggctggggcggcaccgcacggcccaccggtcccggcgcgacgaccagcgtcgacacgtacgtcaacggcggccgctacgaccgccgtatccacgtcggcaactggtgcaaccagtccggtgccggtctcggtgagcgcccgcaggccgcaccggccaccgggatcgacgcgtacgtgtggatgaagcccccgggtgagtccgacggctccagctcggccatcgcgaacgacgagggcaagggattcgaccggatgtgcgacccgacgtacacgggcaacgcccgcaacggcaacagcatgtcgggcgccctgccgaacgccccgctgtcggggcactggttctcggcgcagttccaggaactcatgaagaacgcgtacccggcgctg

SEQ ID NO: 96 - DNA, 2919 bp, Streptomyces avermitilis
atggcatccagaaggagacgccgcaccgtgcggcggttgtggaccgccgtggtcgcggccctggccctgcccgtgacgaccctggcaaccggaatctccgcgccgtccgcgcaggccgcggcgctccagtgcagcgtcgactacaagacgaacgactggggctccggcttcaccacggacgtgaccgtcaccaaccggggcacggacccgatcaacggctggaccctgacgtacgcctacaccggcaaccagacgctcaccggtggctggagcggtacctggtcgcagtccggcaagtcgatcaccgtgaagaacgcgtcctacaacgggacgatcgccgccggagccgccgtcaacaccggggcgcagttctcgtacagcggcaccaacacctcccccacgggcttcgcggtcaacggcaccacctgcgccggcgcccaccagccgccggtcaccgtgctgaccagccccaccgccggcgccgtctacacgcagggcgacgcggtcccgctcgtcgccaccgcggccgccgccgacaacgcgacgatcagcaaaatcgagttctacgacgacacgacgctgctgggtacggacaccagctcgccctacacgctgtcggccgccggcctgagcgtgggcggtcactcgctgatcgcgaaggcgtacgacagcctgggcgcgtcggcggagtccactccggtcggcatcacggtcgcctcgggtcccgccgtggtggcctcaccgacccaactgggcgtccagcagggcaagtcggggacattcgccgtgaagctgtcgacacagccgagcgcgaacgtcaccgtcggtgtgacgcgtacggacggaaacaccggcctgtccgtcaccggtggatcgtcgctcaccttcacgccggccaactggaacacggcgcagacggtgaccatcaccgccgacgcctccggcaccggttcggccaccttcacggccttggcgaccggccacaccaaggccacggtcacggtcacggaactggccgggtcgaaggcgtacgacgcccgcttcctggatctctacggcaagatcaccaacccggcgaacggctacttctcccccgaaggcatcccctaccactcggtggagacgctgatcgtcgaggcgccggaccagggccacgagacgacctcggaggcatacagctacctcctgtggctccaggcgatgtacggcaaggtgacgggcgactggtcgaagttcaacggtgcctgggatctcatggagaagtacatgatcccgacccacgccgaccagccgaccaactccttctacaacgcctcgaagccggcgacgtacgcgcccgagctggacactccgggcgagtacccggcgaagctggagcccggcgtcccggccggctcggatccgatcgccagtgagctgaagagcgcgtacggcacggacgacgtgtacggcatgcactggctccaggacgtcgacaacgtctacggctacggcaacgagcccggcaagtgcgaggcgggcccgaccgccaccggaccgtcgtacatcaacaccttccagcgcggtgcgcaggagtccgtctgggagacggtcccgcagccgacctgtgacgccttcaagtacggcggcacgaacgggtacctggacctcttcaccggggactcctcgtacgccaagcagtggaagtacaccgacgcacccgacgccgacgcgcgtgccgtgcaggccgcgtactgggccgacgtctgggccaaggcccagggcaagggcggtgatgtgtcggggaccgtcggcaaggccgcgaagatgggcgactatctgcgctacgccatgtacgacaagtacttcaagaagatagggaactgtgtcgggccttcgacctgcgccgcgggcaccggcaaggacgcctcccactacctgatgtcctggtactacgcatggggcggcgccaccgacacctcggcgggctgggcctggcgcatcggctccagtcacacccacggcggctaccagaacccgctcgccgcgtacgcgctcagctcgtacgccgacctgaagcccaagtcggcgacagggcaggcggactgggcgaagtcgctcgaccggcagctggagttctaccgctggctccagtcgagcgagggtgccatcgcgggcggggcgaccaacagctgggcgggccggtacgcgaccccgcccaccgggacgccgaccttctacggcatgtactacgaccagcagccggtgtaccacgacccgccgtccaaccagtggttcggcttccaggcgtggtccatggagcgggtggccgagtactaccagcagacggggaacgcgaacgcgaaggcggtcctcgacaagtgggtcggctgggcgctgtccaagaccacgatcaacccggacggcacctaccgcatcccctcgacgctccagtggtccggctcgcccgacacctggaacgcgtcaagtcccggcgccaacacgggacttcatgtcaccgtcgccgactacaccgatgacgtgggggtggccgcggcctatgccaagaccctgacgtactacgccgcgaggtccggcagcacggcggcgaagacaacggcgaaggcactgctcgacggcatgtggaacaactaccaggacagcctcggcgtcgccgtcccggagacccgcaccgactacaaccgcttcgacgacagcgtgtacgtcccgagcggctggaccggcaagatgccgaacggcgacgcggtcaactcctcctcgaccttcacctcgctccgctccttctacaagaacgacccggcctggtcgaagatcgagagctacctcgcgggcggcgccgcgcccacgttcacgtaccaccgattctgggcccaggcggacatcgcgctcgccatgggttcgtacgcggagctcctcgaa

SEQ ID NO: 97 - DNA, 1125 bp, Streptomyces avermitilis
atgcgaccgtcaccgccccatgcccgcagcgcgcgtggcctgttcggtgccctgctcactgcgctcgtctcgctggccgcgttgctgaccaccgcctcggtggcgcaggccgacaccagcatctgcgaaccgttcgggtcaacgacgatccagggccgctacgtcgtccagaacaaccgctggggcaccagcgaggcccagtgcatcaccgccaccgactcgggattcaggatcacccaggccgacggctcggtacccacgaacggcgccccgaagtcctacccgtccgtctacaacggctgccactacaccaattgctcgcccggcacgagccttccggcccagctcagtaccgtctccagcgcgccgaccagcatctcctacagctatgtcagcaacgcgatgtacgacgccgcgtacgacatctggctcgaccccacgccccgcaccgacggcgtcaaccggaccgagatcatggtctggttcaacaaggtcggatccgttcagcccgtgggctcgcaggtcggcacggccaccgtggccgggcgccagtggcaggtgtggtccggcaacaacggctcgaacgacgtgctgtccttcgtggcgccgtcggcgatcaccagctggagcttcgacgtcatggacttcgtccggcaggccgtttcccgcgggctggcgcagaacagctggtacctgaccagcgttcaggcgggcttcgagccctggcagaacggcgccggcctcgccgtgacctcgttctcctccacggtcaacaccggcggcggcaaccccggtgaccccggcagccccacagcctgcaaggtggcctacgcgacgaacgtctggcagggcggcttcaccgccgacgtcaccgtcaccaacaccggttcctcccccgtcaacggctggaagctggcgttcaccctgcccgccggacagcagatcaccagcagctggagcgccggcgtctccccgtcatcgggagcggtcacggcaagcagcctcgcgtacaacgcgcagatcgcgaccggcggccgggtgtccttcggcttccagggcagctactccggcaccttcgccgcgcccgccggcttcagcctgaacggcgccgcctgcaccaccgcc

SEQ ID NO: 98 - DNA, 1476 bp, Streptomyces avermitilis
atgcgacatccccctcgttcagcacttcttcttgtcgccggcgcggtcgccctcatcgggagcgcggtcgtgccggtcgtcacggcgtcgggagccacgacgcccgcgtgcacggtggagtacgccgtcaccagccagtgggacgccggcttccagggcggcgtgaagatcaccaacaacatggccgccctgagcagttggcgtctcacgttcgacttcgccggcgggcagaaggtcacccagggctggaacgccaagtggtcccagtccggtaccaccgtgaccgcggccaacgagagctacaacggctcgctgggctccggtgcgagtgtcagcgccgggttcctcgcctcgtggtcggggagcaacgccgtaccgacgtcgttcaagctcaacgggacgacgtgcaatgtggaggcggaaccgtcgccttcaccgtcaccgtcggacccgccggcgacgggtgcggcgccgaaactgcacgtatccgggaacaagctcgtggacgccgacggcaagacgcgccggctgctcggcgtcaaccgttccggcggcgagttcatgtgtgtccagggctacggcatcttcgacgggccggtcgacgacgccgccgtcaaggcgatcgccgactggaaggccaacaccgtccgcattccgctgaacgaggagtgctggctcggcctgtccaacatcaagccggagtacggcggcgccaactacatcgcggccgtcaaggacctggtggccagggtggaggcgcacggcatgacgccggtcgtcgaactgcactggacgtacggccagtacaccggcaactccgccggctgttcggacgtgcacgccacctgccagaagccgatgccggacgcccagtacacgccgtccttctgggcctcggtggcgagcaccttcaaggacgacgcggcggtcgcgttcgacctgttcaacgagccctacccggaccgcgccacctccacgaccacccaggcgtggcagtgctggcgggacggcgggacctgccccggcatcacctacgaggtggccggcatgcaggacctggtcgacgcggtgcgcggcaccggcgccaagaacctgatcctggcgggcgggctcgcgtactcgaacgacctgagccagtggctgacgtacaagcccaccgatgccacgggcaatctcgtcgccgcgtaccacgtctacaacttcaatacctgcgccagtgagacgtgctggaactcgacgctcgccccggtggccgcccaagtcccgctggtggccggggagatcggcgagaacacctgctcccactccttcatcgacaccgtcatgaagtggttcgacgaccggggcctctcctacctcggctggacctggaacacctgggactgctcctccggtccctccctgatctccaactacgacggcactcccacgtcgttcggtatcggactgcgcgaccacctgcgcgccctcaacgga

SEQ ID NO: 99 - DNA, 2646 bp, Streptomyces avermitilis
atgcgaagaacccgcatcttcacggccgtgctcgcgctggcggccggtctgcccgccggcaccccgccggcactggccgcgagcgcccccacggcgacgatcgccgcggacacgtacagctggaagaacgcccgcgtcgacggcggcggcttcgtccccggcatcgtcttcaaccgctccgagaagaacctcgcctacgcccgcaccgacatcggcggcgcctaccgctgggccgagtcctcgaagacctggacgccgctgctcgactcggtcggctggagcgactgggggcacacgggtgtcgtgagcctcgcctccgactccgtcgacccgaacaaggtgtacgcggccgtcggcacgtacacgaacagctgggacccgggcaacggtgccgtgctcaggtccggcgaccggggcgcgagctggcagaagaccgacctgcccttcaagctgggcgggaacatgccgggccggggcatgggcgagcggctcgcggtcgacccgaacaggaacagcgtgctgtatctcggcgcgcccagcggcaaggggctgtggcggtcgacggactcgggggcctcctggtcgcaggtcaccgacttcccgaacgtcggcacctacgtgcaggacgcgaccgacacgagcgggtacgcgtccgacaaccagggcatcgtgtgggtcaccttcgacgagtcgacggggtcgccggggagctccacgcggacggtgtacgtcggggtcgccgacaaggacaactccgtctatcgctccacggacgcgggcgcgacctggtcccggctggccggccagcccaccggccatctcgcccacaagggcgtgctggacgcggcgaacggctgtctgtacctcgcgtacagcgacaagggcggaccgtacgacggcggcaagggacagctgtggcggtacacgacgaagaccgggacctggacgaacatcagcccggtcgcggaggccgacacctactacggcttcagcgggctgaccgtggaccggcagcatccggggacggtgatggcgactgcgtacagctcctggtggccggacacgcagctcttccgctccacggacagcggcggcacctggacgaaggcctgggactacacctcgtatccgagccgctcgaaccgcttcaccatggatgtctcgtcctcgccctggctcacctggggagcgaaccccgcaccgcccgagcagaccccgaaactcggctggatgaccgagtccctggagatcgacccgttcgactccgcgcgcatgatgtacggaacgggcgcgacggtctacggcacggacaacctgacgaactgggacagcggaagccagttcaccatcaagccgatggcgcggggcctggaggagacggccgtcaacgacctcgcctcgcctccctccggcggcgcccagctgttcagcgcgctcggtgacatcggcggcttccggcacacggacctcaccacggtgccgtcgctgatgtacacgtcgccgaacttcaccacgagcaccagcctcgactacgccgagaccgacccgggcacggtggtgcgggtcggcaatctcgactcgggtccgcatgtggcgttctcgacggacaacggcgccaactggttcgcgggggcggacccttcgggggtcagcgggggtgggacggtcgcggccgcgtccgacggcagtcgcttcgtgtggagcccggcgggcaccggggtgcagtacacgaccgggttcggcacctcgtggtcggcgtccgcgggcctcccggccggggcgatcgtcgagtccgaccgggtcgacccgaagaccttctacggcttcaagtccggcaggttctacgtcagttcggacggcggggcgaccttcacggcgtccgcggccacgggcctgccgagcggcgacagcgtgcgcttcaaggcgctgcccggcacgaagggcgacatctggctggcgggcggcgcgagcgacggcgcgtacgggctgtggcactcgacggacggcggcgcggccttcaccaagctcgccaccgtcgaccaggccgacaccatcggcttcggcaaggcggcgaccggcgcctcgtaccagacgctctacaccagcgcgaagatcggcggtgtgcgcggcatcttccggtcgaccgacaagggcgcgagctggacccgcgtcaacgacgatgcccaccagtggggttggacgggcgcggcgatcaccggtgaccccagggtctacgggcgcgtgtatgtgtcgacgaacgggcgcgggatcgtctacggcgacaccgcgggctcttcggacggcggcggtacggagccggcaccgacgggcgcctgcacggtgacatacaggatcacgaaccagtggtcgggcggcttccaggccgatgtacagctcgccaacaccgggtcgaccgcctgggacggctggtcgctgggctggtcgttcggtgacgggcaggaggtcacccagctgtggaacgcctcgtacgcgcaggccggttcgggggtgaccgcagcgaacctggcctggaacgggagggtggcggccgggtcctcggtgagcttcgggttcacgggaagctggtcgggatccaatggcagaccgaccgccttcaaactcggcggtcagaactgcacggtcgcc

SEQ ID NO: 100 - DNA, 807 bp, Streptomyces avermitilis
atgcagcatcgcagaccgcgcctgtccaagaaggcgagggccctggtcgccaccacggtcgtcctcgcggccgccgccggcgtcaccgtcgcccaggcgggcgagaccggcaagaagtgcgcggccttcgacacgatcacgctcggcaagtactacgtgaacaacaacctctggggccaggacaaggccaccggcacccagtgcgtctgggacgactcccggtccggctccacgatctcctggggcacggactactcctgggccaacaactccgccgggcacgactacgacgtgaagtcctacgcgagcagtgtcctcggctggcactggggctggaaggcggacaaggcggcgacgggtctgcccgtccgggtgggcgaccgcaagagcgtgaggaccacctgggacttctcggtcggcgccggtcccggcacgatgaacgtcgcgtacgacctgtggctgcacgccaagaacaacgcggactggcaggaccagcccaccgacgagatcatggtctggctcaaccgccagggcggcgcgggcccgctgggcaccaagtacggcagcgtcagcctcggcggcgcgatgtgggacatctaccagggcgacatcggctggaaggtgtactccttcgtacggcgtacgaacaccaccaaggccacgctcgacctggacgacttcacccaggccctggtccgccgcaagctgctgagcgacgacaagtacgtctccggcatcgaggcgggcaccgaggtcttcaagggcgcgggccgactggacaccaaggcgtactcggtggacatcggc

SEQ ID NO: 101 - DNA, 1014 bp, Streptomyces avermitilis
atgtacgggaagaggggggccggggcactggcggccgtggcgttggcgggggccgcgctgctgctggcggggtgttccgctcccgaggacaacagcaagaagggcggcgggggcgctgacatcgcgcagcggccgaaaggctcggacccgttctgggtcaaccccgaggggaacgcggccgagcagctcgccacctacgcgagagcgggcaggaaggacgacgccgagcaaatccggaagatagcggagcagccgacgggggagtggatcgggccggagaacccggaagcggaggcgcgcggttacacggaggccgcggagaaggcggaccgcaccgcgctcctcgtcctctacaacattccgcaccgcgactgcgggcagttctcgcagggcggcgccgcggacggcgacgcgtaccgggcctggatcgacggcgtgaccaagggcatcggggaccggaacacgacggtggtcctggagccggacgcgctgctgcacatcgtcgacggctgcacgccggacgagttccacgaggagcgctacgacctgctcaagggcgcgatcgccaagctcggagcgctgaagaacaccaaggtctacctggacgcgggcaacgcgggctggggccaccccgaccagatcttccagccgctccagcgggcgggcgtcgaccgggccgacggcttcgcggtcaacgtctccaacttctacacgacgcgggactccatcgcgtacggcaagcagctgtcggcgaaggtcggcgacaagcacttcgtgatcgacacgagccgcaacggcaacgggccgtacacggcgggcaaggcggacgagaactggtgcaacccgccggggcgggcgctgggcgagaccccgtccacgaagacggccgatccgctggtggacgcgtatgtgtgggtcaaacgcccgggcgagtcggacggcacgtgcaagggcggcccgaaggcgggcgagtggtggtccgactatgcgctgaagctggcccgcgcgtccaag

SEQ ID NO: 102 - DNA, 1110 bp, Streptomyces avermitilis
atggtggcggtggcctcgttcgtggtcgccgtcggcaccgcgacggggatgatgtcggcgttcgacgacggccgtacgcccgaccaggcccgcccgcaagtgaccggcccgcccagccgccggccgctgcccgccgtcccgtccccgtcgcccgccacgacgtccgcgaggccgagtccggccaccccgtcggccgggcccggcccgaagtcctccccgagcaagagggagccgaccactgcggccgcccccgcccagctctatcgccaccccgaatcccaggtcctcgactgggtcggcgcgcatccggacgacgcccggcgcgcggtcatcgagtcccgcatcgccgaccggcccgccgcggtctggttcgccgacttcgctccgtcgaccatcaccgcccgggtcagggcggtcacggcggccgccgccgcgcaggaccgggtcccggtcgtcgtgccgtacacgatcccggaccgcgactgcggcggggcgtcgcagggcggcgcgcccgatctcgccgcttacgacgcctggatcgacaagttcgccgccgggctcggctccggcgaggtcatcgtcatactggagcccgactcggtcgcccagtccgactgtctgtccgaggggcggcaggccgaccgcttcgcctcgctggctcgcgcgggccgggtcctcaaggccgcgaaccccggggtccgggtctacttcgacggcgggcactccgagtggaatccggccgccaaacaggcctcgctgctcgaccaggcgggcgccgcctcgcccgccgcctccgacggcatcttcacgaacgtgtccaacttccaccgtacgagcgacgagatcgcgtacgcccggcaggtgctggccggcctcggcggccccgcgagcctgggcgccgtcatcgacaccagccgcaacggcaacggcgcgccggccggcggcgagtggtgcgatccggcgggccggaagatcggccgggcgccgaccctgacgaccggggaggccgggatcgacgcctacctgtgggtgaagctgccgggcgagtccgacgggtgcaagggcacgcccgggaccttctcgcccgcctacgcctatgaactggcgcgc

SEQ ID NO: 103 - DNA, 1074 bp, Streptomyces avermitilis
atgccccacacaacagccgcccaccgtcgtcgcgcctcccgtcccctccccctcgtagccgtcggcgcgctggtcgccgccgccgtcgccctcccccagctcaccccggacgcctttgccgccaccaccctccggggctacgccgacggccgcggcgtgcggatcggtgcggccgtcggcgacagcccgttgcggagcgactcggcgtacaccaccgcgctggaccgggagttcaactccgtcaccgccgagaacgcgatgaagtgggacgcggtggagcccagccggggcggcttcgactgggccgccgccgaccggctcgtcgcgcacgcgagcgcacacggccagggagtacgcgggcacaccctggcctggtacgcacagctgccgtcgtggctgaagaacggcaacttctcggcctccgagctgaacacgatcctcaagagccacatcgacaccgaggtcggccgctacaagggcaaggtgtacgcctgggacgtggtcaacgagacgttcaacgaggacggctcgatgcgcggttcgctgtggcaggacaagctcgggaccgggtacatcgcgaacgcgctgcggtgggcgcacgccgccgaccccgccgccaagctgtacatcaacgactacaacatcgaggcggacaacgcgaagagcgacgccctgtacgcgctggcgaagcaactcctggcggacggggtgccgttgcacggcatagggttccagtcccacttcgtggtcgggcaggtgccgtccaccatgaaggccaatctcaagcgcttctcggacctggggctcgaggtctccgtcaccgaactcgacatccgcatccccctgcccgcctcctccgacgaactggctcagcagtccgccgactacaagacggccagcgagaactgcctgggtgtcgcgcgctgcgcgggcatcaccgtgtggggcgtcagcgacaagtactcatggatcccggggacgttcagcgggtacggcgcggccctcccgtacaacgagagctacgcggcgaagcccgcctacaccgggctgtcgaacggactcgatccgaccgcg

SEQ ID NO: 104 - DNA, 1353 bp, Streptomyces avermitilis
atgagatctctgaaaagatcaggcttatccccggcgtccttgctcaccggcatcgcggccctggccgccctgctggccgcggcccccgccgcgcacgccgccgacacgccgctccgtgacctcgccgccgccaagggcaaggtcatcggtaccgcggtcaccggctccaagctgaccggcacgtacggcgacatcgccggggcccagttcaactcgctgacccccggcaacgccatgaagtggggctcggtcgagcccacccagggcacgtacaactggaccgaggccgaccagatcgtcgccttcgcgcaggcccacaaccagcaggtacgcgggcacaccctggtctggcacagccagaacccgagctggctgacgaacggcacctggaccccggcccagctcggcacgctgctccagaaccacatcaccaccgaagtcacccgctaccagggcaagctggcggcctgggacgtggtgaacgagccgttcaacgaggacggcacctaccgctcgaccctctggtacaacggcctcggctccgattacatcgcccaggccctgaccgcggcgcgcgcggcggacccgagcgcgaagctctacatcaacgactacaacgtcgagggcgtcaacgcgaagagcaccgcgctctacaacctggtcaagtccctcaaggaccgcggggttccgatcgacggggtcggcctccaggcccacctcgtgctcggccaggtgccgtccacgctccagcagaacatccagcgcttcgccgacctcggggtggacgtggcgatcacggagctggacatccgtatgcagctgcccgccacggacgcgaagctgacgcagcaggcggccgactacaaggccgtgctggacgcgtgcgtggcggtgacccggtgcgtcggcgtcaccgtctggggcttcacggactccgactcctggatcccggacgtcttctccggctacggcgcggcgacgccgtacgacgagaactacgcgccgaaaccggcgtaccacgcgatcgcgacggcactcgggggcacctcgacaccgcccacgggcgcgtgcacggcgacgtacagcgtcacgagccagtggaacgcgggcttcacgggccaggtgcggatcgcctgttccggggcctccctgtcggcgtggaaggtgagctggacgtacggcgcgggccagcagatcacgcaggcgtggaacgcgacgtgcacccagtcggggacggcggtgagttgcgcgaacgcctcctacaacggcaccgtcccgaacggcggttcggtcaccttcggcttcaacgcgtcatggagcggaagcaacccgctgccgacagtgacgctgggg

SEQ ID NO: 105 - DNA, 1308 bp, Streptomyces avermitilis
atgatcctcacctccgacctgggcgacggcacctaccgcacccccgtcctgaacgccgactggtccgaccccgaccttctccgcgtcggtgacgacttctacctcaccgcctccagcttcggccgggccccgggcctgcccctgccgcactcccgcgacctcgtcaactggaggctcgtcggccatgcgctcccgcgcctcgaaccggcgcacgagttccggaccccgcgtcacgactgcggagtgtgggcgccctccctgcgccaccactacggctggctctggatctccgcgcccgccgggggagtgcagaccggctggcagggcgccttccgctcgcccggcttcttcgggccgtacgaggagcggatcgtgctggagcagggcgacaccgacgtcgacggaccgcaccagggcggctgggtgcgcaccccggccggcgaggactggttcgcgcacttccaggcgcggggcgcgtacgggcgggtcgtccacctccagctgatgcgccggggctcggacggctggccggtgatcgggaatgagggcgtccccgtggccgtacacaggaagccggacctgccgcggcagccgccctccgcgcccgccaccgacgacgacttccccggcggccggttcgggcgtcagtggcagtggaccgccaaccctctccccagctctcggctgcgctcgagcaggggtgacccccatgacggctgggccacccagctctccggcgacgggctgcgactgacctgcgtgcgcaccgccgacgcgcacgacctgcgcaagctcccgaacgtgctcacccagcggctgcccggcgcgcccgccaccgtcgaggtggagctgcggctggacagcgaggaacccggggcccgggccggactggcggtgctgggcgacgcgttcagctggatcgggctccaacgcggcagggacggctcggtccagctggtgcaccggttcgacgaatccgtcgccatgggggcaccccccacaccttcggggcagtgggggaaggagcgggacgccgcgcacgcgcggctcgcgcccggcgggcgggcccggctgtggatcgagatcggcaggggagcgcgctgccgcttctcgtacgacaccggggacggccgtcggccctccggcccggtcttcgccgccaccccctggcgctgggtcggcgccctgatcgggctcgtcgcgctcgcgcccgtcggcgcgggccacgccggcgcggccacgttcacccggttccgcggcaccgccgccggctccgcctccctctctgcccccgcctccacctcggcc

SEQ ID NO: 106 - DNA, 2205 bp, Streptomyces avermitilis
atgcgccgcaccgcccgcacactcctggtgcctctcctcgctctgctgctgggcctgctcgccgcgccgcccagccccgccgcacagtccggagcaccccacgtgaacgccgccaagtacgccggctatctcttcgcctacttcaccggggagggcaccgccgacggcgagcagatccgctacgccctcagccgcggcaacgacccgttgcactggcgggagttgaacgcgggaaagcccgtcctcacctcggacctgggcgagaaggggctgcgcgacccgttcgtgatccgctcccccaagggtgacaagttcttcctgatcgcgaccgacctgaagatgtaccggaacagcagcggcagctgggaccaggtccagcggcacggcagcaggtccatcatgatctgggagtccaccgatctggtccactggaccgaccagcggctggtgcgggtcgcccccggcaacgcgggcaacacctgggcgccggaggcctattgggacgacacgctgggcgcgtacgtcgtcttctgggcgtcgaagctctacgcggacgacgaccccgaccacacgggctcgacgtacaacaagatgctgtacgcgaccacgaaggacttccgcaccttcagcgagccgaaggtctgggacgacccgggctactcggtgatcgactcgaccgtcatcaagcacaagggcagttactaccgctacaccaaggacgagcgcgacccgagctcgtccagcccctgttcgaagttcatcaccggcgagaagtcgacgtcgctcacggacccgacgtacgacttcgtctccgactgcatcggcagcggttcgatcgaccggggtgagggccccacggtcttcaagtccaacaccgagaacaagtggtacctgttcatcgacgagtacggcggccgcggttacgtccccttcgagacgaccgacctcgactcgggcgagtggaccatgtcgacggactaccagctgcccgcgagcccgcggcacgggacggtcatgcccgtgacgcgggccgagtacgaccggctcctggccgcgtacccggtgagcggcacctcggtggtggacgcgacggcgaaggggcagaaggggtacgcggtcgtctccgaggacaccgcgaaggtcgtgctgccgatgaagccggacgcggacctgcggagactggccccggccctggccgtcggcgcgggcgcgaccctgagcccgcgctccggtacgcggcgcgatttccgcaggccgcagacgtacacggtgacggcggcggacggcacgaggcgcacctggaccgtcgaggcggtaccgacccgcagcccggtcctgcccgggctgtacgcggaccccgacatccagtacctggacggccgttactggatctacccgaccacggacggcttccccggctggagcggcacacggttcaaggcgttctcgtcgaaggacctggtccactggaaggaccacggcgtgatcctcgacctggggcctgatgtgacgtgggcggacaagaacgcctgggccccggcgatcgccgagcgcgacgggaagtactacttctacttctgcgcggagcagcagatcggcgtggcggtggccgactccccggcgggccccttcaaggacgcactgggcaagcccctggtcgccaaggggaagttggcgggccagatgatcgacccggcggtgttcacggacgacgacggcacgtcgtatctctactggggcaacggacacgggtacgtcgtgccgctgaacgacgacatggtgtcgtacgacgcgacgaaggtgaaggacatcacccagccggacttccgcgagggatccttcgtggtcgagcggcaggggacgtactacttcatgtggtccgaggacgacaccggcagcgagaactaccacgtctcctacgcgaccggaccgtccccgctcggcccgtggaccaagcggggcacgatcctgtccaagcgccccgagtacggcatcaaggggaccggtcaccactcggtggtgaacgtgcccggcacggacgactggtacatcgtctaccaccggttcgccctgagcggtcccgggaaggcgggcggggacggcacgcaccgggagacgaccatcgaccggatgaccttcgcggccgacggaacgatcgagccggtgacaccgacgctggagtcggtcaggcccgtgcgcgcaaac

SEQ ID NO: 107 - DNA, 1521 bp, Streptomyces avermitilis
atgatcagcgtccccgccgaggcgaccggacggctctccgacgcctggcgcgcctgcgtcggcacgggccgcatcgaactggccctgcgccgcgactaccaggactccctcgcgctgctccagcgcgagatcggcttccggtacatccgggggcacgggctgctgtccgacggcatgggcgtgtaccggccgtacgcgtacgagggggcgcggcgtgtgcaccactcgttcacctacgtcgatcaggtcgtcgacgcctacctgggtctgcatgtccgccccttcctcgaactcggcttcatgcccacggagttggcgagcggcgaccagacggtcttctggtggcgcggcaatgtcaccccgccccgctcgtacgacgagtgggcgcggctcgtgcgggcgacgctcacgcacctcgtcgaccgctacggcatcgaggaggtgcgcacctggccgatcgaggtgtggaacgagccgaacctcaccgacttctggcaaggggccgacgaggccgagtaccaccgcctgtacgaggtgaccgcgcgcacggtgaaggacgtggacgcctccctccaggtgggcggcccggcgatctcgcccggcgccgacgagtggctgctccggtttgccgagttcgcggagcgccgcgaggtcccggtcgacttcgtgtcgcggcacgcgtacacctcgggaccggcccggccggtgcccttcggcgcgtaccagaccctcgccccggcgcggcggctgctcgaccagttcgcccggccgcgcgagcagctcaagggcacgagatacaccgaactcccggtccacatcaccgagttcaactcctcctaccgtccggacaatccgatccacgacaccgcgttccacgccgcctacctggcgcccgtactcgcggcgggcggcgaccacgcggactcgttctcgtactggacgttcagtgacatgttcgaggagtccggtgtgcccaccgcgctgttccacggcggtttcgggctgctcacccaccgccaggtcaagaagcccacgtaccacctgtacgcgttcatggcccggatgggggaggaactgctggagcgcggcgacgaccatctcgtcacccgccaccccgacggtcgggtcaccgtactggcctgggcgcccgtcgacgagaccggccgcacaccgggcccggaccggcacaccctgcggctgtccgtgcccgtgggcaggaggccgcgcggcgccgccttcgtccggcgctccaccgtggacgaggagcacggcaacgcgtggaccgcgtggcggcacatgggcggcccgcgctcgccccggccccaccagatcgatctgctgcacgaggccgccgaacccgcccgcagccatctgcgcctccccgtcgaggacttccgcgccgacctcggcctcaccctcgcccgccacgaggtcaccctggtggagctgagccccgtcgaggacgagacaccgccgtggtgggacgagcggcgcctgctgggctccccggtggagccgcga

SEQ ID NO: 108 - DNA, 1392 bp, Streptomyces avermitilis
atgatcctcttcgccctgtgtctcgcgttcgccggcgccctcacgaccgcgggcccggcccgggcggcggcccagaccctcaccaacggcacccagttcaccgacacttcgggcaacggcgtgcacgcgcacggcggcggggtcatcaaggtcggcggctactactactggttcggcgaggaccgcaacgccgacaacaccttcaagtacgtcgacgcctaccgctccaccgacctgaagaactgggagttccgcagccacgtcctgacccaggccggcgcgagtgagctggcgagcgccaacatcgagcgtccgaaggtcatgtacaacgcgtccaccggcaagttcgtgatgtggatgcacaaggagaacggcaccgactacagcgaggcacgcgccgcggtcgcggtgtcggacacggtcgacggcacctacacctggcagggcagcttccagccgctcggccagtacatgtcccgcgacatcacggtcttcgtcgacaccgacggcaccggttacatggtgtccgccgcccgtgagaactacgacctccagatctaccggctcaccgccgactacaccggcatcgacagcctcgtcgccgacccctggcacggcggacaccgcgaggcacccgccctcttcaagcggggcggcgtctacttcatgctgacgtcgggcgccacgggctggaaccccaaccagcagcagtacgcgaccgccacctccctggccggcccctggaccgcgatgacgaacgtcggcgactcgacggcgtacggctcgcagaccgcgtacgtccttcccgtgcagggcacttcgggcacctcgtacctctacctgggcgaccgctggggcaactccttcgggggcagcgtcaacgactcccgttacgtctggctgccgttgaccttccccacctcgaccagcctcagcatgagctggtacccggaggtaaccgtcgacacggtcgccggcacgatcagcgggacgagcgccacgtacgagacgctgaccgcccggcactccgccaagtgcgccgacgtccccagtcagtcactgctcacgggcgtcgcgctcacccagtacacctgcaacggcggcaacaaccagaagttctggttcaagtccgtcgccggcggctactacgagctgatgggccggggcagctccctgtgcctcaccgagaacgtcaccgccgtcacccaggagaactgcaccgccgcgacctcccagcagtggtcgctcaccacctcgggcggctacgtcagcctcaagtcccgcgcgagcggcgaatgcctggacgtgtccggcgcgtccaccgccaactccgccgcgctgatcacgtacacctgcaacggaggcaccaaccagcagtggacgcgtggcaca

SEQ ID NO: 109 - DNA, 2226 bp, Streptomyces avermitilis
atgacccacccctggcaggaccccgctctgcccgcagccgtccgcgccgccgacctgctcgcccggatgaccccccaggagaagaccgcccagctctacggcgtctggcccggctccgacgaggcaccgggcggggacgtggcaccgctccagcacgcgctgtccgagggcgtggacctcgccgggctgctcccgcacggcctcggccagctcacccgccccttcggcacggcgcccgtcgacccggccgagggcgccgcccggctcgggttcctccaggaacgcatccgcgccgcgaaccgcttccggctgcccgccctcgcccacgaggagtgcctcaccggcttcaccgcctggcaggcgaccatctttccgacaccgctcgcctggggcgccagcttcgatccggacctggtgaaggagatggcggccgcgatcggcgcctcgatgcgggccgtgggcgtgcaccaggggctggcccccgtcctcgacgtcgtacgggatccgcgctgggggcgcacggaggagtcgatcggcgaggacccctacctcgtggccaccgtcggcaccgcctacgtgcagggccttcagtcgtccggcgtcgtagccacgctcaagcacctcgcgggctactcggcctcacgcggcgcccgcaaccacgcgcccgcgtcgctcggcccgcgcgaactggccgacgtcatcctgccgcccttcgagatggcggtacgggagggcggcgcccggtcggtgatggcggcgtacaacgacatcgacggactgcccgcgcacgcgcaccaccggctgctcacccacctgctgcgggacgaatggcagttcaccggcaccgtcgtctccgactacttcggggtctccttcctggagtcggcccacgggctcgccgactccccggccggggcggcggcgctcgcgctcgcggccggggtggacgtggagctgcccgcggtgcggtgcttcggggccgggccgttcgacgaggaactggtggaccgggccgcgctgcgggtgctgacgcagaagtgcgagctggggctgctcgacccggactgggcgccgcccgccaccgaggccccggtcgacctggacccgccccatatgcgggcgctggcacgtcagttggcacaggagtcggtcgtcctgctcgccaacgaccggggcctgctgccgctcgctccgggggcccgccggatcgccgtcctcgggccgcacgccgacgacccggcggccatgctcggctgctacaccttcccccgccatgtcctcctggaccgccccggggtcccgatgggggtcgccgtgccgacgctgctggaggcgctgcgcacggagctgccggacgccgagttcgtgaccgacccggcggcggccgaggtgtgtgtggtcgcggtcggcgaccggtcggggctgttcggacgcggcacctcgggggagggctgcgacgcggcggacctcgaacttcccgacggacagggcgaggtggtggaccgggccctcgcctccgggacgccggtcgtcctggtcctgctgtccgggcgcccgtacgcgctcgggcgctgggcggaccggtgcgccgcggtggtgcaggcgttcttcccgggcgaggaaggaggcccggccgtggccggggtgctgtccgggcgggtcaacccgtcgggccggctgccggtgagcgtgccgcgcggcccggcgggacagccgtggacgtacctcgccccgccgctcggccggcacggcgaggcgagcaacctcgacccgacccccctgtaccccttcggacacgggctgtcgtacacgacgtacgactggcaggccccgtcggtcgacgacgcgtcgttccccacggacggcgagacgacgctgcgcctgacggtccgcaacaccggggaacggcccggcacggaggtcgtccagctctacctccacgacccggtcggcaaggtcgcgcggccggtggtccgcttggtggggtacgcccgggtgcccctcgaacccggcgcgtcgggggaggtccacttcacggttccggcggacctggccgcgtacacgggccccgacggcgagcggatcgtcgaacccggggcgctggagctgcggttgggggtgtccagcgcggacggggacgtgcggtacacggtgccggtgacgctgaccgggcccgagcgggtggtgggacgggagcggcggctgcggtgcgaggtgcgggtgaag

SEQ ID NO: 110 - DNA, 1263 bp, Streptomyces avermitilis
atgcacggcacgcccgccgtcccgcccaagaacaccggaccggaagtgggctggggcttcacccacacccagttcagcgccgacgagggcagcggcgacgccacccagcgcgtcgaggggctgctcgcgcagcgggcggtgccccagatccagcacatcatgggctggggggccggcaaccccgagcccgtcaaggggcgttacgacttcgcggagatggaccgccgcatcgacttcatccgcgagtccggcggcacgccggtggtcaccctgtgctgcgccccggactggatgaagggcggcaagtccggtgcggacaacaccgactggagccggtccgccctggagaccgcaccggatcccgaccactacaaggacttcgcggcgctcgccgtgacggtcgccaagcgctatccggacgtacgccacttcatcgtctggaacgagttcaagggcttctggaacgactccagggcccgctgggactacgagggctacaccgagctgtacaacctggtctacaaggccctgaagaaggtcgacgagaagaacatggtgggcgggccctacctggtcatggacagcgtcgacccgcgccagcaggagaacgcctcgacggccgtgaagggcccgtggggtgccatggaccagcgcgtcctcgacgccttcgactactggaacaggaacaaggccggcgccgacttcgtcgtcgtggacggctccagctacaccaaggacgacgacctcctgccgaacgagttcgcggccacggacaagctcacggccgtcggcgagtgggtgcgtgcgcggacccgcggcctgccgctgtggtgggccgagtactacgtcgagcccgccgacggcaacgacgaccgcacgggctggtccgagacccggcgcgtcgccgtccaggccaccggaatgatcgcgatggccaggggcggtgcctcctccggcttctactggaacccggaggaggagcggggctccgactgcgcgggttgcctgtggaccccgacctccggcggcgacggcggcacgaaactgcccatgtacgacctggtctcgcggttcggcaaggagttcccgccggggacgacgtacgaaacggtgccggtcgccaaggacgacgtgcccaatgtccgcgtcctcgccgacgacaaggccgtcctcgtggtcaacaccctcgaccgggcgatcagcgcgaaggtcgacggaaagcggttcgagttgccggcgtacggggtgaagtggctgcggcgc

SEQ ID NO: 111 - DNA, 1356 bp, Streptomyces avermitilis
atgaccatcgacctcgccgcactcccgcacgacttcctgtggggtacggccacagcggcgtaccagatcgagggagccgtcgccgaggacggccgctcgccgtcgatctgggacaccttctcgcacacccccggcaagatcgacaacaacgaccacggcgacgtcgcctgcgaccactaccaccgctggcgcgaggacatcgggctgatgaagcaactcggcaccaacgcctaccggctctccgtcgcctggccgcgggtgatcccgggcggcgacgggccggtgaacgccaagggcctcgccttctacgacgagttggtcgacggtctgctggaagcgggcatcaccccgtccgtcaccctctaccactgggacctgccccaggtcctccaggaccgcggcggctggcccgaacgggcgaccgccgagcacttcgccgcgtacgcagcggtcgtcgccgaacgcctgggcgaccgcgtcacccactgggccaccctcaacgaacctctctgctccgcctggatcggccacctcgaaggcaagatggcccccggcctcaccgacctgaccgccgcgatccgggcctcgtaccacctgctcctcgggcacggcctggccgcccaggcgatccgcgccgcggccccggccgccgaggtcggcatcgtcaacaacctctccaccatccatgccgccagcgaccgccccgaggacgtcgcggcggcgcgccgcatggacggccacgtcaaccgctggtggctggacccggtccacggccgcggcttcccggccgacatgcgcgaggtgtacggcgtcgaactgcccgagcagccgggagacctggcgacgatcgccgcgccgctcgactggctgggcctgaactactacttcccggccaccgtcgccgacgaccccaccggaccggctccgcgtgtccgctcggtccgccggctcggcgtcccgcgcaccggcatggactgggagatcgacgccaccggcatcgagaccctgctgctgcgcctcacccacgagtacgggccccgcaagctgtacgtcaccgagaacggctccgccttccccgacgtggtacgccccgacggcaccgtcgacgaccccgaacgccaggactacctcgtacgccacctggccgcgtgcgcctccgcggcccgcaagggcgcgccgctggccggctacttcgcgtggtcgctgctcgacaacttcgagtgggcgtacggctacgacaagcgcttcggcctggtccacgtcgactaccgcacccaggtccggacgatcaagggaaccggccatcgctacgcggacatcgtccgcacccaccggggccgggcgcgccgggccgcc

SEQ ID NO: 112 - DNA, 1446 bp, Streptomyces avermitilis
atggcatccgccgagacctccgcggcacctgtgtcgcccgtgacgtttcctcccgccttcctctggggcgcggcgacctccgcgtaccagatcgagggggcggtgcgggaggacggccgcacgccctcgatctgggacaccttcagccatacgccgggaaagacggccggtggcgagaccggtgacatcgctgtcgaccactaccaccgctatcgcgacgacgtggcgctgatggcggagctcggccttggcgcgtaccgcttctcggtctcgtggtcgcgggtgcagccgatgggccggggccccgcggtccagcgcggcctggacttctaccgccggctggtggacgaactcctcgcccacggcgtcaaaccggcgctcaccctctaccactgggacctgccgcaggagctggaggacgcgggcggctggcccgagcgcgacaccgcgtaccggttcgcggagtacgcgcagatcgtgggtgacgcgctgggcgaccgcgtcgagcagtggatcacgctgaacgagccgtggtgcagcgccttcctgggctacggctccggggtgcacgcgccgggccgcacggacgcggcggcttcgttgcgcgcggcgcaccatctgaacctggcgcacggcctgggcacctccgcgctgagggccgcgatgccggcccgcaacacggtcgcggtgagcctcaactcatcggtggtcaggaccgtttcggacagtcccgcggatgtggccgcgggccggcggatcgacgacctggccaacggggtcttccacggcccgatgctgcacggcgcgtatccggcggggctgttcgcggcgacggcctcggtgacggactggtcgttcgtccaggacggcgacctggaggcggtcaaccagccgctggacgcgctggggttgaactactacacgccgacgctggtctcggcgacggagtcggccccggcgggcccccgcgcggacggccacggagcgagctccttctccccctggccgggcgcggacgacgtcgtgttccacctgacccccggcgagcgcacggagatgggctggtcgatcgacccgaccggcctgcacgaactgatcatgcgttacacgcgggaggcgcccgggctgcccctgtacatcaccgagaacggcgcggcgtacgacgacaagccggacccggagggccgggtgcacgaccccgagcggatcgcgtatctgcacggccatctgacggcggtccggcgggcgatcaccgacggcgcggacgtccgcggctattacctctggtccctgatggacaacttcgagtgggcgtacggctacggcaagcgtttcggcgcggtgtacgtggactacgcgacgctggcccgtacgccgaagtcgagcgcgcggtggtacgcgcaggcggcccggacggggacgctgccgggggcgacagccgccgag

SEQ ID NO: 113 - DNA, 1323 bp, Streptomyces avermitilis
atgatccggcgcatggcgacgaacccgatatctcagttcccggccggcttcctgtggggtgtctccacctcggcccaccagatcgagggagccgcggacgagcgcgagccctccgtgtgggacgccttcacggccgagccgggccgggtgaaggacggctcgacggcggcggtggcctgcgaccactaccaccgctacgccgaggacgtggcgctcctcgccgacctgggcgtggacgcgtaccgcttctccgtgtcctggccccgggtgaactcacccggcggcctcgacttctacgaccgcctggtcgacgagctgtgcgcggcgggcgtccgccccgtgccgacgctcttccactgggatctgcccctcgcgctggactggctcgaccgggacacggcggcgcggttcgccgagtacgcggcacgcgtggccgagcgcctcggcgaccgggtgacgaagtggatcaccctcaacgagcccgccgagcacaccctgctgggccacgcgctcggtgcgcacgcccccggcaggcagttgctcttcgacgcgctgccggcggcccaccaccagctcctcgcccacggtctggcggtacgggcgctgcgcgcggccggggtcaccgacatcggcatcgcgaactcgcacggaccgacctggccggcctcccaggagccggcggacctggaggcggcggccttctacgacctcctcctcaaccgcctgttctccgacccgctgctgctcggccggtacccggaggggatcggtgagctgatgcccaaaggctcagcaggcatcgagtccgatctgaaggtcatcgcggagccgatcgactggtacggcatcaactactacgcgccgacgaaggtgggcgctccccagggcgcggagatcgagttcggcgggctcacccttcccgcggaactccctttctccgtacgggagatcgagggtcacccggtgacggacttcggctggccggtggtgcctcaggcgctgacggagttgctgacgggcttccgtgagcggttcggcgaccggctcccgccgatcgtcatcaccgagaacggctgctcgtacgagggcatcgacgaccaggagcggatcgcctacctcgacggccatgtgcgggcgctccaccgcgcggtggaggcgggcgtcgacgtgcgcggctacttcgtgtggtcgctgctggacaacttcgagtgggcggaggggtacgagcgccgcttcgggctcgtacacgtcgactacgacaccctggagcggacgccgaaggcctcgtacggctggctgcgggacgcgctgcgggcgcggaga

SEQ ID NO: 114 - DNA, 966 bp, Streptomyces avermitilis
atggccctgttcgacctgcctctcgaccagctccgcggttatcgcagcgcgtcggccgagcccgaggacttcgacgccttctgggccaagacgctccaggaggcccgccagtacgacctcggtccccgtttcgagccggtcgagacgcacctcgagacggtcgaggtgtacgacgtcacgttcgccgggttcgacggtcacccggtgaagggctggctgacgctgcccgcccgggcgaacgcgccgctgccgacggtcgtggagttcatcgggtacggcggcggacgcggccttccgcacacgcatctgctgtgggcctcggccggcttcgcgcacttcgtgatggacacacggggccagggcagcgcgtggggcggcggtgacactcccgacccggtgggcagcgggcccgctttccccggattcatgacccggggggtggaggaccccgaaagctactactaccggcggctgttcaccgacggcgtccgtgccgtggaggcggcccgggcccatcccctgaccgactccgcccgcgtcgcggccgtcggcaccagccagggcggcggcatcacgatcgcggtgggcggcctggtccccgacctggccgcggtcgcgccggacgtgccgttcctgtgcgacttcccgcgcgcgacgacgctgacggaccgcgacccgtaccgcgagatcggcaggtacctcaagacgaaccgcggccgcacggagcaggtgcagcgcacgctgtcctacttcgacggcgtgcacttcgccgcccgcgggagcgctcccgcgctcttctccgcggccctcgaggaccagacgtgcccgccgtccaccgtcttcgccgccttcaacgcgtgggcgcacgccgacaaggcgatcgaggtgtacgacttcaacgaccacgagggcggcggcccctatcaggaggcggcacagctgcgctggctgccggaccgtcttcga

SEQ ID NO: 115 - DNA, 999 bp, Streptomyces avermitilis
atgcgaggtgccgtgcccgcattcgatctaccaccggccgaactggagaaccaccgccccgccccccacgagcccgccgatttcgacgccttctggcaggccaccctgaaggagtccgggcaggccgagccggtcctgtccgtgcggccgttcgacagcggcctgcggctggtcgagacctgggacgtgaccttccgcggcttcgccggcgacccggtgcgcgcctggtacacccggcccgccgaagccccgcgaccgctgccggccgtcgtcgagtacgcggggtacggacgcgggcgcggactcccgcacgagcggctcacctgggcggccgccgggtacgcccatctcctcatggacaaccggggccagggcgaccagtacgggtgcggcggcgacacccccgacccgcacgccacggcaccgagcggcccgggtccggccgtacgcggactgctggacccgcgcgactaccactaccggcgcctgatcaccgacgcggtgcgcgccgtcgccgccctgcgcgcgctgccgggggtggacggctcacgggtggcggcggtcggcaacagccagggcgggggactcgctctcgccgtcgccgggctcgtccccgacctcgcggccgtactggtcagcgcgcccttcctgtgcggcatccggcgcgccctcgaactcaccgacgccgccccgtacggtgagatcaccgcctatctcgccgtgcaccgcggcgccgaggcggctgcgtatcgcaccctctcctacgtcgagggcgtctccttcgcccggcgcgcgaccgcccccgcgcacttcgggatcggtctgcgcgacacggtctgcccgccgagcggcgcctacgccgcgtacaaccgctacgccgaactcaccggccacgaccccttgaaggagatccacccctacccgttcaaccagcacgaaggcggcgacgccgtccatgtgcgccgccaactcacttggctcgacggcatcctgggcggc

SEQ ID NO: 116 - DNA, 1443 bp, Streptomyces avermitilis
atgagacgtctcaccgtccgcctgttcaccgcggtcctcgccgcactggccctgctcaccatgggtacgcccgcccacgcgaccgccccggcctcgccctccgtgaccttcaccaacccgctcgccgagaagcgtgccgatccgcacatcttcaagcacaccgacggctactactacttcaccgccaccgtgccggagtacgaccgcatcgtgctgcgccgggccaccacgctccagggtctggccaccgcccccgagaccaccatctggaccaagcacgccagcggtgtgatgggcgcccacatctgggcgccggagatccacttcatcgacggcaagtggtacgtgtacttcgccgccgggtcgaccagcgacgtgtgggcgatccggatgtacgtcctggagagcggcgccgcgaacccgctgaccggcagctggaccgagaagggccagatcgccacgccggtgtcctccttctcgctcgacgccaccaccttcgtcgtgaacggcgtccgtcatctcgcctgggcgcagcgcaatcccgccgaggacaacaacaccagcctcttcatcgccaagatggccaacccctggaccatcagcggcacgccgaccgagatctcccagcccacgctgtcctgggagaccgtcggctacaaggtcaacgagggtccggccgtcatccagcacggcggcaaggtcttcctgacctattcggcgagcgccaccgacgccaactactgcctgggcatgctgagcgcgtccgcctccgccgatctgctcaacgccgcctcctggacgaagagttcccagcccgtgttcaagaccagtgaggcgaccggccagtacggcccaggccacaactccttcactgtctccgaggacggaaagtccgacatcctcgtctaccacgaccgcaactacaaggacatcagcggcgacccgctcaacgaccccaaccgccgcacccgcctccagaaggtctactggaacgccgacggcacccccaacttcggtattcccgtggccgatggcgtcaccccggtccgcttctcctcgtacaactacccggaccgctacatccgccactgggacttccgggcgcgcatcgaggcgaacgtcaccaacctcgccgactcgcagttccgggtggtcacaggtctggccggcagcggcacgatctccctcgaatcggccaactacccgggctactacctccgccacaagaactacgaggtatgggtggaaaagaacgacggctcatcagccttcaagaatgacgcgtccttctctcggcgggcgggcctggccgactccgcggacggcatcgctttcgagtcgtacaactatcccggccgctacctgcggcactacgagaacctgctgcgcatccagccggtcagcaccgccctcgaccggcaggacgccacgttctacgcggaa

SEQ ID NO: 117 - DNA, 1407 bp, Streptomyces avermitilis
atgaccgtagaagacagaggcataccgtccgacccgccggcgccgtcgcggcgcgggatactgcgggccctgctcgcgctgcccgccacggcgctcgtgtggggcgaaatgccgggggcggtgggttcggcggccgcggcggcgccgtcgaaggggtatgccacgcggtacaccatcgtgccgttcctcaacagcgacgacggcgtcgtgaacgtctatcagtccgacgacgccaccgacttccggctgctcaaggccaccgcgtacaccccgccgagcaaccggatccgcgacgccagtgtcttcaagcacaccaacggctactactacctcacctacaccacgcacacctggcaggacgtcagcaccaccatcgggttcgcgcgcagctccgaccgggtgaactggaccttcctgtacgaccacaccgtccccctcacgaacctgtcccgcgcgtgggcgcccgagtggttcgtcgacagcgacggcagcgtgaacgtcatcgtgtcctgctcggccaccgacaacgagtggatcttcaccccgtatctgctcaaggccaccaacaccgggctcacctcgtggtccgcgcccgtggccctgtccggcatcggcgccaaccacatcgacacgtacatcgtgaagatcggctccacctatcacgccttcaccaagaacgagacggccaagtacatcgagtacgccaccgccaccagcctcacgggcccgtacacgatcagcaggaccggcgactgggcgggctggggcagctatcgcgagggcccctcggtggtgcggctcgacaacggcgggtggcggatcttcttcgacggctacggcgacggcacctactacttcagcgacagctacgacaccttcgccacctggaccgcgccgaaggcactggccggcatctcgggcaccgcacgtcacttcaccgtcgtcaaggagacggtctccggcggtgtcagcctctccaccggcgtcagccgctccttccagtccgtcaactacccgacccgctactggcaggagcagtcctccctgctcaacctgcccgtggtgagctccgccgccagcagcgcggagaaggcggcgtcggcgttcacggtcgtggcgggcctcgccgacgccggcgggtactccttccgggacgcggccggaaactatctgcgccactacgactaccgtgcccgcttcgacgccgacgacggaacgccgacgttcgccaaggacgccacgtacgtcgcgcgaacgggcacggccgccggctccgtccgcttcgagtcgtacaactacccgggctactatctgcgccactacaactaccagctgcgcgtggaccccacggacggcaccgaccagttccgccaggacagctccttcaacccggtcaccgcctgggcc

SEQ ID NO: 118 - DNA, 1509 bp, Streptomyces avermitilis
atgcgcactgcccgcttcgccctcgaccccgccttcaccgtcggcgaggtcgacccccgtctcttcggatccttcgtcgaacacctcggccgctgcgtctacaccggagtcttcgagccgggccatcccgcggccgacgaggcgggtctgcgcaccgatgtgctggacctcgtacgggagttgggagtcaccgcgatccgctatcccggcggcaacttcgtctccggctacaagtgggaggactcggtcggcccggtcgacgagcgcccccgccgcctcgacctcgcctggcgctccaccgagaccaaccgcttcggcctctccgagtacgtcgccttcctgaagaaggtcggcccgcaggccgagccgatggtggccgtcaacctcggcacgcgcggggtcgccgaggccctggaactccaggagtacgccaaccacccctcgggcaccgccctgtcggacctgcgcgcggcccatggcgacaaggaccccttcggcatcaggctgtggtgcctcggcaacgagatggacgggccctggcagaccggccacaagaccgccgaggagtacggccgcctcgccgccgagaccgcccgcgccatgcgccagatcgacccctccgtcgaactggtcgcctgcggttcttcgggccagtccatgtccaccttcgcggagtgggaggcgacggtcctggcggagacgtacgacctggtcgaccacatctccctgcacgcgtattacgaacctctcgacggcgatgtggactccttcctcgcctccgccgtcgacatggagtcgttcatcgagaacgtcgtcgcgacctgcgaccacgtgggcgcgaagctcaagtcgaagaagaggatcaatctctccttcgacgagtggaacgtctggtacctgtcccgccacgaggagtccgccctggccgacccgctggactggcccgaggccccgcgcctcctggaggacaactacagcgtgctggacgcggtcgtcttcggctcgctcctgatcgcgctgctgcggcacgcggaccgggtgaccgtcgcgtgcctcgcccagctcgtcaacgtcatcgcgccgatcatgaccgagccgggcggcgcgtcctggcggcagacgacgttcttcccgttcgcccaggccgccaggtacgggcgcggacaggtcctcgacgtacgggtggactcgccgcggtacgagacgaagaagtacggcgaggcggacctgctgcacgccacggcggtccgcgcggacgacggcacggtcacggtgttcgcggtcaaccgcagccgcaccgagccgctgccgctcgaagtggccctgaacggcctggagttgacgtcggtcgtcgaacacagcgtgctgacggacaccgacccggacgcccgcaacaccctcgacgaccaggagcgggtcgccccgcgaacggtctccgggaccgcactccaggacggcaccctgaccgctgccctcgcgccgctgtcgtggaacgtgatccggctggcg

SEQ ID NO: 119 - DNA, 948 bp, Streptomyces avermitilis
atgccagaaaggcagtccgagcccactccggacgagtccgccccccgcccgtggagccccttcgcgagttcgccggcgtccgaaccgtcccaccccgggcatctgccgctgccgacggaggagccgccgacgccgtggcagccgggcggtacgccggacacctcccgcgtacccgggacccgacggctctggctggccggcgccctcgccctggccaccgtcgtcgcctgcgtgaccgcgctcaccacgacggaccacgcggccgacacctcggccgcgaaggaagccgacaccaagctggactcggccgaccccggtctcctcacgttcgcctccccctccgcggggccgagtacctaccccggcgccaagagcggccggtcgagcgagcgagccgcgcagaccactcccgacggctccgcctcggccgaccccgcccggcacggctccgcgtcgaagcccgcggccgagcggtcgaagccggcctcgtccaccggcacgtcctcgggctcgaagccctccgccgtgtggaagtccgtccggtcggtcaactaccccgaccgctactggcatctcggcggtgacaccggccggctcgaccccgtgagctccggcagctcggccacgaccaggcaggacgccaccttcaaactggtcaaggggctcgccgacgcgtcctgctactcgttcgccaccgcggacggcacctacctgcgccactcccggttccgcctgcgcgccgaccgcaacgacggcaccgcgctcttcaagaaggacgccaccttctgcccccgcacgtcgtcgtactccggcgccgtcatgctggagtcggtgaactaccccggccgctatctgcgccacaaggacttcctgctccgcctcgacccgtacgagaacaccggccagtaccgggccgactccgcgttccagctggtgaagggctgggac

SEQ ID NO: 120 - DNA, 2130 bp, Streptomyces avermitilis
atgtcacccacccgcacccgctggagactcggactcacagccgccgcgttactggtggcctcggtcggcgttcccgcgcccgcccacgccgaagacatcaccgactacgcgatcgccgtcgatcccaagggatcgggggcgaagatcgacgacaccatgtacggggtgttcttcgaggacatcaacagggccgccgacggcgggctctacgcggaactcgtgcagaacaggtcgttcgagtacgcgaccgccgacaacacgtcgtacaccccgctcacctcctggaacacctccggtaccgcggacgtcgtcagcgacgacggacggctcaatgcccgcaaccgcagctatctggccctcggcggcgactcctcggtcaccaactccggctacaacaccggcatcgcggtcgagagcggcaaggtctacgacttctccgtctgggcccgcgccgaccaggccgaccccctcagcgtgaccctgcacgacacggacggtgacttggcccgggcccgccgcgtcaccgtgcgcggcggctgggccaagtacacggccaggttcaccgccggccgcaccagcaccaccggccggctcaccgtcgccgccgccggcgccgtcgcgctcgacatggtctcgctcatccctcatgacacctacatggggcacgggctgcgcaaggacctcgccgagaagatcgccgccctgcaccccggcttcgtccgcttccccggcggctgtctcgtcaacaccggttcgatgaggggatacgacgaggcgtcggggtacgagcgcaagcggtcgtaccagtggaaggacaccatcggacccgtcgagcagcgcgccaccaacgccaacttctggggctacaaccagagttacgggctcggctactacgagtacttccagttcgccgaggacacgggcgcgatgccgctgcccgtggtgcccgccctcgtcaccggctgcggccagaacaaggccgtcgacgacgacgctctcctcgagcgccacatccaggacacgctggacctcatcgagttcgccaacggcccggtgaccagcgaatggggcaggaagcgcgccaggatgggccatcccgagcccttccacctcacccacctcgaggtgggcaacgaggagaacctccccgacgagttcttcgcccgcttcacgcggttccgggccgccatcgaggcgaagtaccccgacgtcacggtcatctccaacgccggcccggacgacagcggtccgaccttcgacaccgcctggaagctcaaccgtgacgcggacgtcgacatggtcgacgagcactactacaacagcccccagtggttcctccagaacaacgaccgctacgacgcgtacgacaggaacggccccaaggtgtttctcggcgagtacgcgtcgggcggcaacaccttcaagaacgccctggccgaagccgcgtacatgaccggtctggagcgcaacgcggacgtcgtcaagctggcctcgtacgcaccgctgctcgccaacgaggactatgtgcagtggcgccccgacatgatctggttcgacaaccacgcctcctggggctccgccgactacgaggtccagaagctcttcatgacgaataccggcgaccgggtcgtgcccagcaccgcgagcggcacgcccgccctgagcgggccgatctccggtgcggtcggcctgtcgacgtgggcgaccaccgccgcgtacgacgatgtgcgggtcaccggcgaggacgggaccacgctgctcggcgacgacttcagcggtgacgcctcgcggtggacgcacacgggcggcggaagctggagcgtcgaggacgggcagtacgtgcagagcgacgtggccgccgagaacaccatggtctcggcgggcgacccggcctggcacgactacgacctgcgggtgaaggccaccaagaagtccggcaaggagggcttcctcgtcgcgttcggcgtcaaggacaccggcacctacacgctcgtcgccgcgcccgacgcggtgaactcgcggacggcgacgcctgtcgcaccggtgacgtccgtcttggagggggtggccgacaggttcacgtataccttcccggccaactccgtgacgttcctgcggatcaggcagagg

SEQ ID NO: 121 - DNA, 1608 bp, Streptomyces avermitilis
atgaccgtcccgccatccttcctgagacccctgagcgccgccttcgcgatgctgcttctgctggtcctcgctccggccctgctggtgctccgcgcggcaccgcccgcgcaggccctcgacaacggtctggccaggacgcccccgatgggctggaacgactggaacgccttcggctgcaacgtcaccgagcagttggtcaagcagaccgccgactacctcgtctcctccggtctgaagggcgccgggtaccagtacgtcaacatcgacgactgctggatgacctcggcccgcaactccgtgggccaactggtgcccgacccggtcaagttccccgacggcatcagcggaaccgccgcctacgtccacagcaagggcctcaagctcggcatctacgagagcgccggcaccgccacctgtcagggctaccccggaagcctcggccacgagcagacggacgccgacagcttcgcctcctggggcgtggactacctcaagtacgacaactgcaaccaccagaacgtgcccgaccagcagcgctacaccgccatgcgcgacgccctggtcaacaccggccgcccgatcgtctacagcctgtgcaactggggtctggccagtgtgtggacctggggagcgggggtcgggaacagctggcgcaccaccgacgacatcaacgtcaacttctcgacggtggtgtcgatctacaaggccaacgtcaagctcgctccgtacgccaagccgggcgcctggaacgaccccgacatgctcgaggtcggcaacggcatgtcgttcaccgaggaccgttcccacttcagcctctggtcggagatggccgcgcccctgatcgccggaaccgacctgcgcaaggcctccgccgccaccctcttcctctacggcaacaaggacgtcatcgccgtggaccaggactccctgggcaagcagggcaccgaggtgtcctcctccggcggcctccacgtgctgaccaaaccgctggcgaacggcgacgtgtcggtggtgctcttcaacgagaactcctccgccgccaccatcaccacctccgccaccgcggccggtctccccgcggcatcctcctaccggctcgacaacctctggtcacacgtcgtcagcagcaccggcggaagcatctcggccagtgtccccggccacggctccgtgatgtaccgggtctccgtcggcagtggcaccagcgccgggagcacccacccgctggtcggcgcctcctccaaccgctgcctggacgcgtacgacaaccagaccgcccccggcaccaagatcgagatctgggactgcggcggcgccaaccaggccgtgaccatcaccgccgccggtgaactccggctctacggcggcacccagtgcctggacgcctacgacaacgggaccacttccggcaccaaggtgcagctctacacctgcaacgggggagccaaccagaagtggagcctcaaccccaacggcaccgtcaccggcacccagtcaggcctctgcctcgacgtcacgggcggcgaccaggcctccggcaacgtcaacggcaccgcgctcgaactctggacctgcaacggcggcgccaaccagcagtggcgcctgggc

SEQ ID NO: 122 - DNA, 1824 bp, Streptomyces avermitilis
atggggtcatcctcgtacgccgtcatacccggagccgccccgcgctccggccgccgctccataagagccgtcctcgtcctcgccctcaccgcgggtgtcgcgacggtcgtcccggccgcccaggcggacacgagcacgcccgccgccgctccggtcgccgccaagccgtacatgggctggtcgagctggagcatgcagtcgtcgaagtacccgggcctcaacccggacggcgactacagctatctcaccgaggcgaacgtcctgaagcagacggacgccctcgcctcgaagctgaagaagtacggctacgaccacgtcaacatcgacgccggctggtggatggacaagaactggaagacccagttcgaccagtacggccggcagacgcccgacccggtccgcttcccccacggcatgaagtcggtcgccgaccacatccactccaagggcctcaaggcgggcatctacctgcccgtcggcctggagaagggggcgtacggcgacggcaagacgccgatctcgaaggcccccggctgcaccaccgccgacatcgtctactcggacctgcgcaccaccaacggctgggacaacgcctacaagatcgacttcgacaagtcctgcgcgcagaagtacatcgactcgcaggcgcagatgttcgcggactggggctacgacttcctcaagctggacggggtgggcccgggctcgttcaagtccggtgacaactacaacaacgtcgccgacgtcgccgcctggcagaaggccatcgccgccaccggccgcccgatccacctcgagctctcctggtcgctcgacatcggccacgccgccgactggaagaagtactccaacggctggcgcatcgacaccgacatcgagtgctactgcaacaccctggtcacctgggagaactcggtcaacgaccgatgggacgacgccccggcgtggagcagcaaggcgggccccggcggctggaacgacctcgacgccatcgatgtcggcaacggcgagatggacggcctcaccaaggccgagcggcagagctacatgacgctgtgggccatcaacaagtcgccgctgttcaccggtgacgacctcaccaagctggacagctacggcgtctccctgctcaccaacaaggaagtcatcgccgtcgatcagaacacctcgcccgtcgcgcgtccggtcaccccggtcggcgaccagcaggtctggggcaccaagaacgccgacggcagctacaccgtcgccctgttcaacctcggcgactcgccggcctccgtcaccgcccactgggcttcgttcggattcaccggcaacgcctccgtgcgtgacctgtggaacaagacgaacctcgggacccacaagaacaagatcaccgaggcgctgcccgcacatggctcgcggctgttcacgatcaagcccggcggcggcaccctggcgaccacgggctacgaggccgaggccgcggccaacaccctgtcgggcaacgcctccgtcggcggatgtgacgcctgctccggcggcaagaaggtcggcaacctgtacaccggcggcaagctgcggatcaacgacatcacggtgaagaaggacgggatctacaccgtcaaggtcgcctacgtcagcggcgacccccgctcggtgaccgtcctgtccaacagcggtaacggcacgagcctgaagttcccctccacgggcgactggagcacggccgagaccgtcagtgtccaactggcactgaaggcgggctcgaacaccatcacgttcgacagcggcagcggatacgcacccgacatcgacaggatcgtcgttccgcagtccgtc

SEQ ID NO: 123 - DNA, 2046 bp, Streptomyces avermitilis
atgcgtcacccctacgcccgcacaacccgcacaacccgcacaacccgcacaacccgccgaagagtcgtcggagcgctcaccgcaggactgttgtgtacggccgggctcgcggcgccggccctcgccgctcccgccgccggtccggtctcgccccggccggccgacagcctcgccctcaccccgccgatgggcttcaacaactggaactccacgggatgccgaccggagttcaacgaggacatggtcaaggggacagccgacatcttcgtcgagaagggtctcaaggacgccgggtaccagtacgtcaacctggacgattgctgggccctgccggcccgggactcgaacggcaagttggtgccggatcccgctcgattcccgggtggaatcaaggcggttgccgactatgtgcactccaaagggctcaagctcggcatctacaccagcgcgggcaccaagacatgcaacgaagccggtttcccgggcgcgctgggccacgagtacagcgacgcccaacagttcgcggactggggcgtcgactacctcaagtacgacaactgcaacaaccagggtgtcgacgcgaagctccgctacaccacgatgcgtgacgcgctgaaggccacggggcgccccatcgtctacagcctctgcgagtggggcgagaacaagccctgggagtgggcgtcggacgtcggacagctgtggcgtacgaccggggacatcagcgacagttggggctcgatgctgtcgatcctcaagcagaatctgcccctcgcgccgtacgccggtcccggccactggaacgacccggacatgctggaggtcggcaacagcggcatgaccgacaccgagtaccgcacccacttctcgatgtggtcgatcatggccgcgccgctgctcatcggctcggacctgcgcaaggcgtccgccgcgaccttcgacatcctcgacaacaaggaggtcatcgccgtcgaccaggacccgctgggcaagcagggcacggtgctctcctccgagggcggacgctgggccgtcaccaaggagatgaaggacggcagccgggcggtggccctcttcaacgagacggacagcgcacagcggatcaccaccaccgcgcaggccgtaggactgccgaaggcacacgcgtacacgctgcgcgatctgtggcagcacaggagctacaacaccgccggcacgatctcggcgaccgtcccggcgcacgggacggtcctcgtacgggtctcggccgacgccgcatgggccaagaacccgcccgccgtcgaactgggcgtggacggcagcccgttgctggaggcgggcaggacggtcgccctgacctcggcgctcaccgacctcggccgtacgcccgcgaagcgtgtctccgtgacactgagcgggccccgggggtggcgggtgagggcgacctcgccgaccaccgcgggcacggtgccgacaggccgttcgctgcgcacgaagtggaaggtcaccgcgcccgacggcacggccgccggctcgtacgacctgacgctgaaggcgacctaccgctcgccgacgggggtacgcgccgagaccctggtgccgctcgcggcgtccgtggtgccggccccgccctcgggcgtctcctacctcggggacctgccctggatgtcgacgaccaacggctggggcccggtggagcgcaacaccagcaacggtgagagcgccgccggcgacggtcgtccgatcactgtcgacggcgtcgtccacgccaaggggatcggtgtgcacgccgagagcaccatcgcgtactacaccggcaggtcgtgcgagacagtcaccgcggacgtgggggtcgacgacgagcaggacaccaatggcagcgtcaccttcgagatctgggcggacggcaccagagtcgcctcgaccggggtcctgaccaccgcgatgccggcgcgaccgctctcggccgatgtgaccggcgcccaggtggtccggctggtcgtcaccgacggcggcaacggcatcacctcggaccacgcggactgggcggacgccaagctcagctgc

SEQ ID NO: 124 - DNA, 2589 bp, Saccharophagus degradans 2-40
atgaagcaatcacaccacaataccaagggtaagcttggtctaggcagggcgctgttgtgcggcctaatgcttagtgtcatgttgggctcttctgcccacgcacaatttgttcacacagacggaaccagaattcttgatgaaaacggagaagagctaaactttaacggcatcaacctaggtaactggttgttatgggaaggttacctgatgatgggcgattttaattatcgcactcacacccagtttttaaattcacttaccgatgctttcggtagcgccgctaaagctgcagagtttgagcaccaatggcgattgaattatgtagatgagcaagccatcgccgatttaagcgcgcttggctttaactcggtacgtgtgccatttcattacaatatgttttgggaaaatggccagttaagcaatcacggttttcaatatttcgatcgcgtaattgagtggtgtcgcacttacaatatgtatgtgttgctggacatgcacgcagcgccggggtaccaaaaccctggggatcacgcagacaatgtcgattcgaatgcgagccagccgcgcgatacggtaaaattttgggatggcaataatgtacaaattgccgctaccgtttggcgtcatattgctaaccgctataaagatgagcctgtagtttggggttacgatttaattaacgagccagtaccgcagccaactcgcgagtttgaattgcttagctctatggtaacaatgcgcaacgccattcgcgaagttgataataaccataccattgtggttgaaggtagctggtggagttccgatctaactaaaatagattggactgacccagaagtacaagcggcttccggagtttattcccagtgggatgacaacttggtgtatcagctgcatcactacgggccgctatctgacactgtgggtcgagatgcgattaccgacaacctcaatatcccgcttattattggtgagtacggcgaaaccgacaacggtaacttagcggcaatgaccgattgggctaagcaaaatttgtcggggtattttccttggtcgttcaaaaaaatgtcgcacgacaaaaccctttggacgattccaccaaacgcggcctacaatcaagtaaaagcctatataaataatggtggtacaccgccaacgcatttgtacgctgatatgattgcgtttgcacaaaataatgtgcgcaatggtcatagcagtcatcaatggcaccaaggtttttacgatgcaattaacccgggcaatacgccaccaccaccgcctccgcccccaccacccgcaccaacgtgtgatgacagtaacgcgcagacattcactttgcccagccgcgttcaagctgaagatcactgcgcaagcagtggtattcaacaagaaagcaccggcgatattgatggcaaccaaaacattggctggatagatgcaggcgattgggccgaatacaacgttacgctaaatacagcaggtgagtacacttttgcagcgcgggttgcggcgaatgctaatgctggcaccatcaacgtagcggtaaatggcagccaagttggcagcctcactgcgccagtaaccggcgattggcaggtgtaccaaaccacgcaaattactgtcaatcttcctgctggtgagcatgttttacgcttaaattttgctagcgcgggcatgaatgtaaattggtttgaagtgagtgaaggtcaagcgccaccccctccaccccctgtaaacccatgtgacggttttatgcaaaatctacctagtaaagtagaggcagaagattactgcgatatgaatggtttacaaaccgaagcgacaagtgattccggcggcggtgaaaacatcggttggatagacgcaggtgattgggcggactacggcattaatgtagatacaaacactcactttattcttaagttacgtgttgccagtcaaaacggtggcggcaaggtaaacataaatgtagatggcgctaacgttggtggctttgatgtgtcgagcaccggcggctggcaaaactggcaaacactttctatgccgttaacgttaagtgcaggtaaccatgtattacggttagattttcttgccggtggtttaaatgttaactgggttgagtttacacctgctacaaccacgccacctaccgagccgcctgccacgggcgaattagaggaaggtacttactacattactaacgaagcctctggtaaagcgttagatgtgtctggtgtgtctactagcaacggtgccaatgttcatcaatgggcatatggcggcggtttaaatcagcagtggaatgcacagcacgtaagtggcaatacgtttgagttggtaagtctaaacagtggttcttgtttggatgccgacagcgggagcgataacgcacatcagtgggcttgcgaaggcaacactaaccagcagtgggttattgaagagcaatcagatggcagctacttaattcgtaccaaagccggcaacgaagtattagaagtgcaaaatggcagcgctaataacggtgctaatgtacgtactgccggtgcagccaatagcgatcgtcaaaaatggcgttttaacattgttcag

SEQ ID NO: 125 - DNA, 2559 bp, Saccharophagus degradans 2-40
atgaaaagtaccaaaatatttacacgtaaaaagctcgcactaagcaccatgcttattgcatctgccattggtttacaggcctgtggtggtagctccaatggcccacaaaatattgtacctgtaccgccagcttttgaagaacccgcagcgggcgcagaaagctacagcatgctaaaagctgaaggcacactatggatgaaccaagcgggcgaaaaagtttctttgcgtggtattaacataggcaactggttgagcatggaattttggatgttcgacaacggtaacgatccgctaggcgcaggtatacccgatcagtgtacattagaagctacactcgaagagcgttttggcgaagcggaaaaagaccgattaattagcgtgcaccgcgatagttggtttgtagaacaagattgggacgtaattgacgaagcaggctttaaccttgtgcgtgttcctttccctcacaacttaatcgaagacgatgctaacccaatgacgttaaaagaaaacgcatgggattatttagattgggcaatagccgaagcaaaagagcgtgaaatttacgtagtgctcgatttgcacggtgctgctggtggccaaggttatgagcaacatactggttgcgaaggccagaatatgttgtgggaaagcgaagagtatcaagagcgcaccaaatggctgtggggcaaaattgccgaacgctataacggtgaagccactgttgcagggtacggcttattaaatgaaccttggggtacagattctgccacgctgcgcgatttctcaatcgagctttacgacgcagtgcgcgaatacgatgaagatcacatcgtaattcttgctggccacaatgccgacggtattacagcgtatggcgacccgcttgattacggaatggaaaacgttgcgtttgaaccgcacttttacccaggcttatttggttggggtgacataggctacgaagtacaccgcgactggttaacttgcggccaagcgggcgataccggcgtgtgtgattgggcaaaacaagcacgcgatgtatacacgccaatgctagttggtgaaatgcaaccttggaatggtttaggtgagttgggcggcgaaattactcgcgctacattcgatacctacaacgacctaaattgggccgcgacggcttggtcttacaaagttactacgccttctggtggtttgggtaatggtacttggggctacgtgaccaacaacggtaaccagctgttagttaaagcgcaaacgtggggttgtgatggttgggaagatacttttgccaccgcctgtgatgtgtctgcgcgtgcaacagtaccgtacgaaggcgaaggcactaaaactatgtacctcgctattaaaaccggcggttttactcaagtagatgttatctacgacgaaattcaattggtagattcacaaggcaataacatcgttactaatggtagctttggtgcgggttctgaagccgattggacagaaatatctttatggggtgacgagcgcaattacgattacgactacgccgcaggtgaatttgcaggtagtgataccggtgcagctttccgcgcagtttctccagcgggtagccatgcagtaatttatcaagcggtagaagtaaccggcggcgaaagctacaccatttctggtaagtttattgatgctaacagtaccgatacttgggcagaaatttatttagtaccagagatgccgcaagaatgggttgatgtcactggccgcgcattaccttctattaatgtaaatgaagcgacggtggaagatatagaaaactacttctcattcttcgcgtacggcaatatggattatgttgtaaacgattgggttaaggatgcgcttacttcagctgcacctgcctctgtatttactaacattccaggcgctgccagcgatgttacctttactttgggtgcggcagacgacaacggtattgcggctaccaccttaacctgggcaagtgctacgggtgatgtaacagggtataaaatttatcgctctactgcaccgcgttctggttttactgttgtaggcgaaagtgataccacaacctataccgataacacctccacggcagatgtaacttactactactacgttgcagcgtttaacgacagtgacgaaggctacggcagcgacattattgcaaccggtgaaaccttctacaccgtgcctagcaaaatagaagctgaaaactataccgcagctcaccctggtgttaacaccgaaggcgctagcgacataggtggtggctctaacattggtagcttcgaaaccggccgctgggtggattatgaaattaatgttcctactgcaggtgtttatagcatcgacttccgcttggctagccaagtaggtgatgtgcagttccaagtgaaaattggcagcgacgtacttaccactgttaccgtacctaacaccggtggctggcaagactacgtaaccaatacctacgaaataacgctaccagaaggtcgttcgacgctacgtttagagtctatagataaccaatggaacttgaattggtttgaaattaaa

SEQ ID NO: 126 - DNA, 2607 bp, Saccharophagus degradans 2-40
atgagagaaaaactactgcgcgcactgttaacaagcgccaagttctttggggcgagcttactactgcttagcctatttaaccttaccgcctgtggcggaggctccagcggcactaagcccgtagtggaagagccacagccagaaccgcagccagaaccagaacctgaaccggagccagaacctgaaccggagccagaaccagaaccgcagccagaaccagaaccagagcccgacttctcggccctacataccgatggcactaaatgggttaacgccaatggcgaccaagtgttgttaaaaggtgtgaacctgggcaactggctattgcaagagttttggatgatggagcaaggctctgaggatgtgaatgatcaatgctccctcgaagctgtttttgacgaccgctttggctttgctgagcgcgagcgtcttatggatctgttccgcgataattggataaacgatcgcgactgggacattatcgcctcgttcggtatgaacgttattcgcctgccgtttatttggaacctaatagaagacgaaaacaaccccatgacactgcgtgacgatgcgtggcagtacattgattacgccattgagcaggccgaagcccgcgacatgtatgtaattttagatttgcacggtgccgtaggggcacaagggtgggagcatcacagtggctgtgctgagcttaatgaatactggggtagcgaagcttaccaagagcgtacgcgctggttgtggcagcaagtggctacacgctatgccgaccgcgacgcagtagcggcttacggcgtgctaaacgagccgtggggcaccacaccagaaaacctcgcagtagaagccatcgaattattcgatgctattcgcgaagtggatgccgacaaaataattattttaccagggcaccactcaggtattcacgcgtaccctaaccctgcaactgtaaaccaaaccaatgttgcttacgaaatgcacttttaccccggtatttttggttggggtgaaataggctacgacgtaaaccgcgactggttaacctgtggcccaacgggcaccagcggcgtgtgcgaatgggatgcgcgcttagatgcattagattccccgtttttaattggtgaatttcaaccgtggacaggcctaggccccgaacttggtgcgcaaattacacgtgccacttacgatacctacgcgagtttcgattgggcatctacggcgtggtcttacaaaattattaccagtggcggcggtcaaggtggtggcacatggggcatggtaacaaacgagcgcggtttaggtttattggccaaagccgatacttgggcctgtgccggttgggatagcagctttgccaacgcatgtggtgtaagtcgcaccggttttacgcccgatagagaaggcgagcaaacctactatttagtgattaaattcggcgcctgttgcgaaggtaacctcgatgcaacattagatagcatcagcattatcgacgatgtaaccggcgaagaaataattgtgaatggcggctttggtgctggtaccggttggaccgagtggtacgaaagtgcaatgcccattatcgattacaactacaccggtgcaggtgtgcctacgggtagcgatggcgcggtgttacgcatgagtggtgctgcagccattaacggcggcgtgtaccaagctataacgttagattccagcaaaagctatagcttctctggtgtatttaaagataacggcagtgcaagtgcatgggcagaaatattcttagtgcaaagccagccggttgatggcagcgatgtattagccgaaggcccatttgccgcggtagattttttaaccgcaccgatagaagaaatagaaaatctatttgaagcctttggcactaccccgtacgacattcacgaagaaatgcgtgcagccatgaccgccgaaacagcgccaaccttgtttgacctgcccggcgcacctaccggcgtaatgctagccgaagatgcaggcgcagcaacaataagttggaccgcaagcggcgatgccaacgtgactggctacaatgtttatcgctcaacaatttctggcaacagctataccttgttagctgaaaatgtaacagctaccaccttcgtggatagcaccatagatggcgagcaaactttctattacaccgtaacggctgtaacagacacggcagaaagctatcgcagccaagaggtagccactacctttgtagccgtgcatttacctggcaaagtagaagcagaagctcatagcgatatgatgggcttacaaaccgaaaacactaccgataccggcggcggtattaatattggctttatagatgccggcgattggtttgaatacgaagtaacaatcgataccgcggcgacctataacatccactaccgcttagcgagtgagccgggcagcacaggctttaccgtatctataaatgatgaagtgctaaataccgttgccgtacccgctacaggcggttggcaaacatggcaaaccgaaagtacaactatcaccttacccgccggcgaacacacattgcgctttgatgcattgggtggccagtggaatatgaattggtggagtgttgaagcagttgac

SEQ ID NO: 127 - DNA, 3501 bp, Saccharophagus degradans 2-40
atgacaattaaacgttggccgttcgaccgaaaaggcccacctaaaaaacctaacgctaaaaaattactcgcaagcttagcggctgcactaagcttaaccgccatgcaaagcactgcagcggtagagccattacaaaccagcggcaatcaaattcttgttggcaaccaagccaaagcccttggcggccacagcttgttttggcataacgtgccggcagcaggcagcttatacaatgcagatacagtaagcaggcttaagaatgattggaactccaaggttattcgggccgcaattggggttgaagtacctttcaattcagaaaacacctacataggcaataagggcagctcgctggccgcaatagaccgcgtagttaatgccgctgttgccaacgatatgtatgtgattatcgattttcatactcaccatgcagatcaagtagaaaacgttgcccacgactttttcaacgaagtttctagccgttacggtcatttaaacaatgttatttatgaagtatttaacgagccagaatggtgtggcgagcacggtcggtgggcatctaccattaagccctacgccgagcgcgttatccaaaccattcgcaacaatgacccagacaacctagtaatagtaggcactacctgtttctcgcaagatgtagatgtagccgcagccgaccccattaacgatgtaaacgtggcctatacgctacacttttacgcagccacccctgcccaccagcaacccttgcgcgacaaggcccaaaccgcgctcgaccgcggcgcgccactatttgtaaccgaatggggtacaaccacatttacaggtgatggttttgtagatgaggcgcaaacgcgcacatggattaactggttaaacgaacgcggtattagccacgttaactggtcggcgtctacccagccagaaagctcagctatatggaatggcgacatgacctacaagcattcgggcttattggttggcgaactggtgcaacaaacaaatggcacaaccacgccaccaaccggtgaaataagtggcccgtgcgatttacattttgtacctgccaaagccgaggctgaaagcttctgtaccgccaaaggcattcaatttgaaaccaccaccgacacgggcggcggccaaaacatgggctggctagatgccggcgactgggtaacttttgatgtagatgtacctgctagcggccaatatttaatagattaccgcgtagcatcagagctaggtgatggtcggttccgcaccgaagccgccaacggcactgcccttggcacaatatctgtacccaataccggcggctggcagaattggcaaacgcacacacacacagtgcaactctcgcaaggcacacaaaccgttaaactagttgccgaaactggtggctggaacttaaattggtttgaagtgcgcgcaggtgaggtgtgcgaaggcgctgactgcccatgtgaaggagccgaatgcccttgcccagattgcaacggcacaccggttaagtttgaggcagaaacgtttgtggctatgcaaggcgtgcagctagaaaacacatccgatgtgggcggcggccaaaacgttggctacattgatagcggcgactggataacttacaacggggccttgcccgcaagtgcagacaaccgctatgtagtgtcttatagagtagcgcgtcaacctagcggcaatgccaaatttaaaatagaacagccaggtggagcagcggtatatggcgaaatttcggtgcccagcaccggcggctggcaaacatggacaaccattagccacaccataacaattcccgctaacgcaaacggctttgcactagcagcaatagatggcggttggaatataaactggatagaaataaaaccggcgaccactcaaccacccgagccaatcaacccgttaaaacttcaagctgaagattacatcaactttaacgacaccacccccggtaacgaaggcggtgcacacagaagcgatgatgtagatattcaagcaactaccgataccggtggcggttttaatgttggctgggtagacgctggcgaatggctagagtatgagttctttttagagtctcctgatttttatgcagctgatgtacgggttgcttcagaccaaactggcggcgcactgcaactacaaatagatggccaaaacgttggccaagccattaccgttggcaacaccggtggctggcaagcgtggacaaccaaaaacacactcattggcgacctaagtgcaggcacccacacgttgcgtgtatacgcgcaaagcggcccattaaatttaaactgggtagagctaaagcgtacaacgcccgcaccagccacttcgtgttttaatattgccgaagaccgcttaaacgttcacctagatgcgcactgtactgcaggcagcaacctgcaatacaattgggattttggtgacggcaacagcgcaaccggcgtagccactagccacagctactacactagcggcacttacaccattaccttaaccgttagtgatacccgcaccacagacacctctagccaacaggtaacggtagatttttctgcccctgcaggccctgtggatttttacggcgaactaatggtgaatggcaaccgcattcacggcgaaaaaaccggcgaacccgcacaagtacgcggcatgagctttttttggagcaacaccggttggggccaagaaaaatggtggaacgccagcaccgtggaccgcatggttgatgagttcaaagtagaacttgtgcgcggcgcaatgggcactgatgaaggcggcggttatttacacgacgcgtctaataaggctcgcttacaagcagttgttgaacaagccattgcacgcaatgtgtatgtaattatcgactggcacacccaccatgccgaagataacattgccgaagccattacattctttagcgaaatggcgcagctttatggccaccacgacaacgtgattttcgagatttacaacgagccattaaacaccacaagctggggcactattaagcactacgctgaacaagttattcctgctattcgcgctcattccgataatttaattgttgtgggcacgcgcacctggtcgcaaaacgtagacgaagccgcgttcgataaaattaacgacagcaacaccgcctacgccctgcacttttatgttggctcgcacggcaaccacgttcgcaacctagcacaaaccgcactaaacaacggcgcggctatttttgctagcgaatggggaatttggccaaacaacaactacgatggcatgaacgccgacgattggatgaactttttagaccaaaacaaaatatcttgggctaactgggccatatccgacaaagtagaccccaacacaggccaactagaaccacccagcatgttcaacccagacggcagcctaagcagtaatggtcaatatgtagtgaacaaactaaatgaatacgcagcacaagcaccgtggagggaggcaatcgctaat

SEQ ID NO: 128 - DNA, 2019 bp, Saccharophagus degradans 2-40
atgttgattggtactgttacggcttcagcactggttggtcgaggccgtggcacccctaaaaaaataatcaacaagggttctattatgtggcaaatcaacaaatcggctttagcggccgtggtattagtgtgttcctcatctagctttgcgcaatctgcatgtgacactcaacgcattgaagccgaaaattacgtggcaatgagtggtattcaaaccgaaagcacggcagacactggtggcggtttaaatgtgggctggatagacgccggcgactggcttagttaccaagttaacctacctgctgcagggcagtacgaggtgcgctatcgcgttgccagtagaaatggcggcggtgtacttcggttagagggcaatgccggtcaaaccttgtatggaactatgaatgtacccaacacgggtggctggcaaaattggcaaaccctttctcattcagtgacattagcggcaggagagcagtctattggtattggtgtgccaagcggcgggtttaatattaattggctggagttcgtacctttagattgcagtgggccaatcgacccgcccattaacccaccttcgaactgcgcgagcattgtattcgaggccgaaaattacgatcaaatgagcggcattagaacgcaaaccacaagtgataccggaggcggcttaaatgtggggtggatagatgctggcgactggcttagctatgccactgtgaatatccccagcacgcaggtgtacaattttgaataccgtgtggctagccctaatggcggcagttttaatttgcagggttcggctggcgcagagaattttgataccgctactttgcccaatacgggtggttggcaaaattggacaacggtaacaggctcggcgcttttacctgctggcaatgtgaatttcggtattagtgcgattactggtggctggaatataaactggtttaaagctacaccagagagctgtgatgatataaaccctccaagtaccggtattactgctaagcaagcagcggcagccatgggcaaggggtttaatttggggcaaatgttcgaaagtacgcaacacccaagaacatttaatgctgcaaaaagtaaaatagatgcttactacaatatgggctacagaaatgtgcgcatccctattacttggactgaagccgtaggcggaaacaggcttgttgcagatgcaaatgtaggcgcagtcaatcgcaaccactctcgcttagctgtaattactcaagtagtagattacgcgctttcgctacccggcatgtacgtggttattaatgcgcatcacgaaggtggattaaaaaccaataatcgctggtgggtgttagaaactctgtgggcagatattgccgatatatttaaagacagagatcaccgtttgctatttgaaatattaaacgagccacacctaagcgatgccaataagtcgcctatgccccccgccaatttgcgttttatgacgggcaaagcctataacaaaattcgcgcgatagatgcgcagcgaatcgttattattggtggcaaccagtggtttggtgcaggtgaaatggcaaacgtatggccaaaccttaatgatgttggcggcggttccgatgcatatgtaatggctacttttcaccattacgacccgtggtcgtttagtggcgataaccaaggcgattacgccgatgcttggacgctatctaacgtgggtaacccaatggatataatgcaaagctgggcaaacggcgtaggccaaggtatgcctgtgtatattggcgagtggggcgtaggttggggcagccgctacagcgccatgcagtgcaataatattcgctattggtaccagctgttcgacgcgagctatgcctcggcaaaaggccagcctacggcagtgtgggatgacggcggttggtttaaaatattcgaccacggtaccaacagcttcaataataatttagcccaatgtattggtggaaactgcgcttgggatggcgccgatagatttaattctggctgtaat

SEQ ID NO: 129 - DNA, 1095 bp, Saccharophagus degradans 2-40
atgcgcacaaccaaatttcttgcgcttgcactctgcttgctggcctcagccagtgcactgagtgcaaataacagcgccccatcaaacgactggtgggatataccctacccgagccaattcgatgtaaaaagccttaaaacgcaaagttttatatcggtaaaaggtaacaagttcattgatgataagggcaaaaccttcacttttagaggggtaaacattgccgatacaggtaagctacttagccaaaatcaatggcaaaaatcgctgtttgaagagctggctaataactggggggtaaatactattcgcctgcctattcaccctgtaagttggcgtaaacttgggccagacgtttatttaggccacatcgatgaggcggtacgctgggcgaatgatttaggtatttaccttattcttgattggcactccattggctatttgcccaccgagcaataccaacaccccatgtacgacaccaccattaaagaaacccgcgacttttggcgcagaattacgttccgctacaaaaacgtgcccaccgtagcggtatacgaattatttaatgagccaaccaccatgggtaacaccctaggcgaacgcaactgggccgagtggaaaaccttaaatgaaagcctaattgatatgatatatgccagtgacaaaaccgtcattccgctggttgcaggcttcaactgggcctatgatttatcgccaatcaaaaaggcacctatcgagcgtgaaggcattgcttacgccgcacacccctacccgcaaaaggcgaaaccagaggttaagaacgataaaaacttcttcaaactgtgggacgaaaagtggggctttgctgcagacacctaccctgtaatagcaacagagctaggctgggtacaacccgatggttatggtgcccacatacccgttaaagacgacggcagttacggcccccgcatagtgaagtatatgcagaaaaaaggcgtttcttacacggtatgggtattcgaccccgactggagcccaacaatgattaacgactgggattttacccccagcgagcaaggcgcgttttttaaacaggttatgctagaagctaaaaaacgc

SEQ ID NO: 130 - DNA, 1830 bp, Saccharophagus degradans 2-40
atgatgtacacaaacctctttaatttaaaaaagcacctctttcaaacctcacttaaactactggcctgcgccacattaattggcggcaccctaaacgcagccgctgacgtgccagcaatgtccgtacaaggcaataaagtactggtgggcggtgaagttaaaagccttggaggtatgagctatttttggtctaacaacggctggggcggcgagaaatactacaacgcttctaccgttagttacttcaagcaagactggaaggcatccattgttcgagctgcaatgggggtagaagatgccggcggctacttcgatgacccgcagggctctaagcaaaaagttcgtacaatagtagatgccgccattgcgaatgatatgtacgtcattatcgattggcactcacattacgccaacacccacgactgggcagccgctgtgcaatttttccaagaaatggcacgtgactatggccaatacaataatgtgatttatgaggtatacaacgaaccactggatatcccttggggccacataaaaagctacgccgaaacggtaattgatgccattcgcgcaattgacccagataacgtgatcgtagtaggcactcctcgctggtcgcagggggtaaaagaagcgtcatgggacccaatcaaccgcaataatattgcctacacgctgcacttctattcaggtagtcatggccaatggctgcgcaacgacgcagcagaagctatgagtaatggtattgccttgtttgttactgaatggggcagcgtaaatgccaatggcgatggcgcagtcaacgaaggcgaaaccgcagcgtggatgaacttcatgcgcgataacggtatccatcacgcaaactggtctgtaaacgacaaagcagagggtgcatctgcacttaaccctggcgccagtgccacaggtggttggggcgacggcgatttgacttggtctggccatgttgtgcgcggctacctgcgcgactggaaccaaattggttctggcaatggtaacggcaacggcacaggctgcaccgaggttagcctaccaggcacgatagaagcggaagcctactgcgcaatggatggtatccaaaccgaaaacaccaacgacaccaacggcggcagtaacgtgggctacatagatgctggcgactggatgagctacagcgtaaacgttgctaacgcaggcacttataccgtgtcttaccgcgtggctagccttggcggcggcggtgttctaagcattgaaaatgccggcggctcgcccgtttatggcacgctgaatgtaccgcaaactggcggctggcaagaatggaccactgtatctcacgatattagcttgcaagccggccaacaaaacattggcatagcggcaatagaaggtggttttaacatcaactggatagccctaacccctgctggcaccaaccccaacccagtgcaaagtattaccttacaagcagaagactactcctttatgagtggcgtgcaggtagaaaatactagcgacaatggcggcggtatgaacgtaggctggttagatgctggcgactggcttgcctaccacggcgtaaacattccaacctctggccaatacaccataacttaccgagtagccagccaaagcggtggtggaagcctgcagctagaacaagcaggtggcggcgttgtttacggtaacctgaacgtaccaagcactggcggctggcagaactgggtagacgtaagccataccgttacccttaacgctggtgtacaagattttgggttaggtattactagtggtggcttcaatattaactggataaaagtcgaggcaattcac

SEQ ID NO: 131 - DNA, 1734 bp, Saccharophagus degradans 2-40
atgaacaaagttaaagttttagcgctgtgtgccagtgtggctgtaatgataggttgcagtgatgccgacactaaattagctaactcggccaaggccgaggtgggctttaccaaagtgaatcagctgggttatttgcccgcggccaaaaagctggcggtggtacccgccgttgcagctgcaaaattcgacataatcgatgtaactagcggtaaagtagcgtttacggggagtttaagcgacgtaaaaagctggagcgcgatgggggacgaatctttcaagttggcagactttagcgccctgcaagccgaagggagttaccgcttagttgttcagggtgtgagtgattcttacaccttcgatattagcccaagtgtatatagccaagcgcacgatggagcccttaaagcctattactataatcgagcgagcacagagttaacagaacagtacgccggggtgtatgcgcgacctgcggggcacccagataccgacgtacgcatattcgataacgccgcctcagccgcgcgcccagcagatacaagctttgctgcaccaaagggttggtacgatgctggcgattacggcaagtacattgttaacagtggtatttccacttacaccctaatggctgcgtacgagcatttcccgtcgttttacaagcaacgcgatatagatattcccgaatctggcgatgccgtaccggatattctcgacgaggtaatgtggaaccttgaatggatgcaggtcatgcaagacccgaacgacggcggtgtgtaccacaagcttaccaccctgaatttttctggcgcagtcatgccgcacgaagcgactgcgcagcgctattttattaaaaaatctaccgctgcaacgctagattttgccgcggttatggccactgcaagccgagtatacgcaccgttcgaaggtgcttttcctggtaaatcagctgcttatcgacaggcggccattgctgcgtgggagtgggcacaagcaaaccctagtgagacatattcgcagacaccgctgagcaaagttcaaaccggcgcctatggtgataaaaagttaaacgatgaatttgcgtgggcggccgcagagttgtttatattgaccggcgagcaaaaatactggcaggcgtttaacaagcaaaaagtgcaggcgggtgagtctagctgggcgaatgttgcggggttggggtttatttccttggccaataatgcgcgcagcctgttaaacgaagctcaatacaaaaccgttaccgattcaattgttcgcgctgcagatagcttgcttgttacttacaaagagaatgcctaccaagtacccattggcaacaaagattttttctggggtggcaattccggcacgttaaatcgcgcttgggttttgcttgaggccaataaaattaaaccgcagcaagaatacatcgatgctgcacttgccgcggtggattatatttatggtcgcaaccctaccaactactcttttgtcactgggtttggcgataaccctgcggtgggtatccatcatcgtccatcctatgccgatggcattaaagcccctgtgcctggttggcttgcgggcggtgcgcacaatggcaagcaagatggttgtgagtacccttccgatgcaccggcaaaatcctatctagacgactggtgcagttactccaccaacgaaattgctattaattggaatgcgccgttagtttacatactggctgcggtaaataatttg

SEQ ID NO: 132 - DNA, 3216 bp, Saccharophagus degradans 2-40
atgaaaaatactttatcctttaaaacatccttgcttgcgggcttggtggcatccagtttactggttgcggcctgtcagggtgttaaacagcaaacggaagctactcagacaaagcacaatattaccttatggccgcaggcgtctagccctgtaataaagtcgccagattacgaagcggaagtggaagccaaggtagaagcgttgttaggacaaatgacgctagagcaaaaagtagggcaaatcctacagccagaaattcaatctattaagccgcatgaagtaaaagaataccacattggctctgtactaaatggtggtggctctatgcctaaccgcatagaaaatgcgccgcccattgaatgggtaaaattggccgatgccttttacgatgcctctatggacgattctgacggtggaatcgcaattcccattatttggggtaccgatgccgtacacggtcacggcaatgtaactggcgcaaccatattcccgcataacataggccttggtgctgcacgcaacccagcgcttatcgaaaaaattggcgaaataacggcaaaagaagtacgcgcaaccggcattgaatggatatttggcccaactttggccgtagcgcaaaacgatttatggggccgcacttacgaaagctactcggaagacccagccatagtggccgactacgccagtgccatggtggtaggtatgcagggcaaagtggacgacagcgattttctgtccactaatcgcgtagttgccacagcaaagcactttttagctgacggcggtaccttaggaggcaacgatcaaggtgatgcgcgcataagcgaagaagagttggtgcaaattcataatgcgggctatgtgcctgccattgaatcgggcgtgcaaacggttatggccagtttctctttgtggaatggcgtaaaaatgcatggtaacaactacctacttacccaagcacttaaagagcgtatggggtttgatggttttatagtaggggattggaatggccacgggcaggtacctgggtgcaccaacgaatcttgccctcaatcgctaaacgccggtttagatatgtacatggtgccttacgattggaaaaaactgtacagaaacttaattagccaagtgcaatcgggtgaaattgccccaagccgtttagatgacgctgtacgccgtattcttcgggtaaaaattcgcgctaatttgtgggctgcgaaaccttcagagcgaattaatctagccactattgacgaggtggttggccacgcaaaccaccgtgaggtagcgcggcaggcggtgcgagaaagtttagtattgttaaaaaataaaaatagcgtactgcctattgctgccaataaaaccgtgctggttgcaggtgacggcgccgataatattggcaaacaatctggcggttggagtgtaagctggcagggcactggtaacaccaatgcatccttccccggtggtacatctatttataaaggtattgccgatgcagtcactcagggcggcggtaaagctacgctttctgtggatggcagctacaaaactaaacccgatgttgccattgtggtaataggcgaagacccttacgccgaaggccaaggcgaccgcaatagtttagagttcgagccggtgaataaaaaatcgcttgagctattaaaaaaattaaaagcagatggcatacccgttgtaacagtatttatttctggccgacctatgtgggctaacccagaaattaacgcgtctgatgcatttgttgccgcgtggttacctggctctgaagggcagggcgtagcagatgtacttataggcaacgccaacggcaagcctcgttttgatttcaagggcaccttgtcgttctcttggcctaagctgccgacccaaggcttgctcaacccaacgcaccccaactacgacccgttatttaaattgggatacgggctaacttatgcctcgagtgaaactggcccagagcaattggcggaagatgttgaaggtgtagataaaggctcaaccggcgacattaatttttatgttggccgcacattagagccgtgggaagtgtttgttcgaactcctgaaagttcgcagcgtttaagtggcccatttgcagacttaggcaatgccagtgtgcgtaccagtgatatgcaggtacaagaagatgcccttacttttacttggggcggtagctggatgtctattctgggaatagaaggagggcgcggttacgacctttcttcgcaatataaagaaggcggagtaataagctttaacttcaattcaatagatatggctaaaggcgatttaaaagtacaaatggcctgtggtgaaggttgcacgcgtgaagtagatatcacaactatcgcacgcgacttggaaggcaaaggctggcagtcgttaacagtgcccttagcgtgctttgcacacgaaggcgacgatttcacccatattactgcgccgtttaacttatttgccggtggaaaaggtcaagttgctgtagccaacattcgcatactgcgcgccggtacacaaaccgtgccgtgtgtattgcctaaagatgtttccgtaacgccagagccgctgaatgctagctgggcgatagattggtggatgccgcgccacaaagaaaaactggcgcgtatccagcaaggtaatgtggatttactaatgattggcgattccattacccacggctgggaagatgcaggtaaagacgtgtgggcgcaatattacgcgcaccgcaatgcagtggacttaggctttagtggcgaccgaaccgaaaacgtattgtggcgcttacagcacggcgaagcagacggtattaagcctaaagtggcagtggttatgattggtaccaacaatgccggccatcgtcacgagccttcgcactacacagccaagggtgttgcggctgtcgttgctgaattgcaaaaacgattgcctgaaacaaagatattattactgggtatattccctcgcggcgaaaccagtgaagaccctttgcgggtattaaatgccaaaaccaatactcttttggcgaaaatggccgacggagagaaggtggtgtatttgaatatcaataaaacgtttttagatgaaaacggcgtattgcctaaagatataatgcccgacctattgcaccccaatgaaaaggggtacgcattgtgggcgaaagcgatggaacccacccttaaaaaaatgctgggcgaa

SEQ ID NO: 133 - DNA, 2586 bp, Saccharophagus degradans 2-40
atgctcaaaaagataaacaagaaaggtcttgctttaagcttagcaattgcagcaatgctaagcggctgcaacgaaggcgacagcaacaaaaccaaaccaagtgcggaaaccctctccgctactcaagccagtaacactgtagccaaccccagcatttggcccaaggtaactagcaaggttgccaaagacgccaaaatggaagcagatataagcgcaatactcagcggtatgacccttgagcaaaaagtagcccaaatgatccaacccgaaattcgtgccttcagcaaagaagacatgaaaaagtatggttttggctcctaccttaacggtggcggcgcattccctaacgacaacaaacattccaccatggccgactgggttgccctagccgacgacatgtatgaagcctctatagacgacagcatagacggcagcactattccaaccatgtggggtaccgatgcagtacacggccacaacaacgtggttaaagcgactattttcccacacaacattggccttggcgccatgcataaccccaagctcatgcagcaaataggcgctgccacggctaaagtggtacaagttactggtatcgactgggtatttgcgcccactgttgcggtagtgcgcgacgaccgctggggccgtacttacgagggctactctgaagaccccgccatagtaaaagaatacgctcgcgccatggttattggcatgcagggcgaagccaatagcgaagcgtttatgggtgacggcactgttatagccaccgccaaacactttttgggcgatggcggcaccgacaaaggcgacgaccaaggcaacaacttatccaccgaacaagaattaattgatattcacgcccaaggctatataagcgccattgaagaaggtgtgcaaactatcatggcatctttcaatagctggaatggcgaaaagatgcacggcaataaatctctgcttaccgatgtccttaaaaagcaaatgggctttgacggtttggtggttggcgattgggatggccacggccaagtaaaaggttgctctaatgcaagctgtgcccaagccatcaacgccggtgtcgatatcatcatggtacccaatgagtggaaacccatgttcgaaaacaccgttgcacaagttaaaagcggcgaaatctctgaagcgcgaattaacgatgcagttacccgtattttacgtgtaaaaatgcgcgctggtattttcgacggtgttaaaccatcggatcgcgccttcgcagcagaagaaaaatacctaggctctgccgaaaaccgcgctatcgctcgtcaagctgtacgcgaatcgttagtgttgcttaaaaaccaaaacaaactgctgccattagaccgcaaaatgaacgttttaatggcgggttctggcgcagacaacatcggcaagcaaagtggtggttggacattaagctggcagggtactggcaacgtgaacagcgacttccctggcgcaacatctatttacgacggcgttaaccaagtagtgagcagcgctggcggtaaagtagagctaagcgaaaacggcaactaccaagccaaaccagatgtagcgattgtagtatttggtgaaaacccttacgcagaaggcgtaggcgatattgaaggtattgaataccaactaaacaataagcgcgatatcaatttgttacaaaaactcaaagccgatggcattcctgttgtatcggtattcttaaccggtcgtccactttgggtaaacaaagagcttaatgcctccgatgcttttgttgcagcttggctgccaggctctgaaggtgtaggcgtttctgatgtgctattcaaaaaagccgacggtagtattaactacgactttaaaggcaagctaacttactcttggccaaagtatgatgaccaagtagtaataaacaaaggcgacaaagattacgccccgctttacccttatggttacggcttaacctacagcgatgttgacacccaaggtgacgacttacctgaagaaaccaaagttaaaattggccgcgctgacgacgagccaatggccatcttcgacagcctaccccaaagcgacctcggcttcttccttggcgacaaagccaactgggtagtacctattgcaacaagtgtagttacaacgcacaacagcgataacctaaccatgcgcacctacaactggaaagtacaagaagatgctcgccagttaatttggaaaggcgacagcaaagccaatgccttctttgcatggccagacccacacaatatgcaaggcatgttagaacacaaagcggcttacagctttagcattaaagtagataaagcacccgctggcgacctaacactaggcatacactgcatggaagaatgcggtaaaaaacttgtgcttaacgaagcgcttagcaaaattcctgctggtgagtggggagagctaacaatagatctagcttgcatagcagatgccgaagccttggccgaagttcgctcacccttcatgctaagcaccgatgcacccgcatctatcgtgtttggcgatgtgaagttagtacctggcggtgcagatagcgcagctattaagtgtgac

SEQ ID NO: 134 - DNA, 1383 bp, Saccharophagus degradans 2-40
atgaaaacctttaacccagatttcgtatggggagcagccagttccgcctatcaggtagaaggcgccaccaccaccgatggcagaggccccagtatttgggatgcgttcagttccattcccggtaaaacctaccacaaccaaaacgccgacatagcctgcgaccactacaaccgctggcaagaagacgtggccataatgaaagagatggggctaaaggcttaccgcttttctatttcttggtcgcgcatattccctactgggcgcggcgaagttaacgaaaaaggcgtagccttttacaacaaccttatcgacgaattaataaaaaacgacattaccccttgggtaaccctatttcactgggactttcctctggcactgcaaatggaaatggacggcctacttaaccccgccatcgccgacgaattcgccaactacgccaagctgtgtttcgcgcgctttggcgaccgcgttacccactggattaccctaaacgaaccttggtgcagtgccatgcttggccacggcatgggcagcaaagcccctggccgcgtatctaaggatgaaccctatatagccgcccacaacttgctgcgtgcacacggcaaaatggtagatatttaccggcgcgaatttcagcccacacaaaaaggcatgataggcatagccaacaattgcgactggcgcgaacccaaaaccgattctgaattagataaaaaagcagccgagcgcgccctagaattttttgtaagctggtttgccgaccccatttatttgggcgactacccagccagcatgcgcgagcgcttgggtgagcgtttacccacctttagcgacgaagacattgcgctaataaaaaactctagcgacttttttggtttgaatcactacaccaccatgcttgccgaacaaacccacgaaggtgacgttgttgaagatactattcgcggcaacggcggcatatcggaagaccaaatggtcaccctctccaaagacccaagctgggaacaaaccgacatggagtggagcattgtgccctggggctgtaaaaaattattaatctggttaagcgagcgctacaactaccccgacatttacattaccgaaaacggctgcgccctacccgacgaagacgacgtaaacatagccattaacgatacacgccgcgtagatttttaccgcggttatatcgatgcgtgtcaccaagcaatagaggccggcgtaaaactaaaaggctattttgcatggacacttatggataactacgaatgggaagaaggctacaccaaacgctttggcttaaaccatgtagatttcaccacaggcaaacgcacacctaaacagtctgcaatttggtatagcacgttaattaaagatggtgggttc

SEQ ID NO: 135 - DNA, 1332 bp, Saccharophagus degradans 2-40
atgaatagacttacactaccgccttcttctcgtttgcgcagcaaagagtttacctttggtgttgcaacgtcgtcttaccaaattgaaggcggcatagattctcgcctgccctgtaattgggatacgttctgtgagcagcccaataccattattgataacaccaacggcgccattgcttgcgaccacataaatagatggcaagacgatatagaacttattgccaacctaggggtagatgcctaccgcttttctattgcgtggggccgtgttattaatttagacggcagcctcaataatgaaggcgttacattttacaaaaatattttaactaagcttcgcgaaaagaatttaaaagcttatataacgctataccactgggacttgccacaacatttagaagatgctggcggctggcttaaccgcgataccgcctacaagtttcgcgactatgtaaaccttataacccaagcgcttgatgacgatgtattttgctacacaacgttaaacgagcccttttgcagtgcctaccttggctatgaaattggtgtacacgcaccgggtataaaagacttagccagtgggcgcaaagccgcacaccatttattacttgcccatggcttagctatgcaagtgctgcgaaaaaactgccccaatagtttaagcggcatagtgttaaacatgagcccttgttacgccggcagcaacgcacaagcagatatagatgcagcaaaacgcgcggacgatttattatttcagtggtatgcacaaccgctacttactggctgctaccctgatgcaataaacagcctgccagacaatgccaaaccacctatttgtgaaggcgacatggcgttaataagccaacctttagattatttaggccttaactactatacccgcgcagtattttttgccgacggtaatggcggttttaccgaacaagtacctgagggtgtagagctaaccgatatgggctgggaagtttacccgcaaggcttaaccgatttactaatagacctaaaccaacgctataccctacccccgttacttattaccgaaaacggcgcagcaatggtggacgaacttgttaacggcgaagttaacgatattgcccgaataaattattttcaaacccatttacaagcggtacacaacgccattgaacaaggtgttgatgtacgcggttattttgcttggagcctaatggataattttgagtgggcactgggttacagcaaacgattcggtattacctatgtagattaccaaacacaaaagcgaacgctaaaagccagcggccacgcatttgctgagtttgtctcgagtaggagc

SEQ ID NO: 136 - DNA, 2433 bp, Saccharophagus degradans 2-40
atgaaatttgggcactttgacgacaaagcacgcgagtatgtaattaccgacccgaaaactccctacccgtggataaactacttaggcaacgaagacttcttcagcctagtatctaacactgggggtggctacagtttttacaaagatgcaaagttccgtcgtttaacacgctatagatacaacaacgtacccgtagacaacggcggtaaatatttttacatcaatgatagtggcgatgtatggagccccggttggaagccggtaaaagcagagctagacgcatacagctgcgctcacggccttagctacacccgcattaccggcgaaagaaacggcattcaagcggaagtacttagctttatccctctcggcacttgggccgaaattcaaaaagttagccttaagaatacctctggcgctaccaaaaaatttaaactgttttctttcgccgaatggtgcctatggaacgcagaagatgacatgaccaacttccaacgcaacttctccaccggtgaagtagaggtggaagactctgttatttatcacaagacagaatttaaagagcgccgcaatcattacgcattctactctgtaaacgcaccaattcagggcttcgacaccgacagagacaaatggaaaggcttgtacaacgattttgataaacccgatgccgtttttgaaggcgagcctcgcaactccgaagcgcacggctggtcgccaattgcatctcactatctagaagtggagctcgcaccaggcgaaagcaaagacttaatttttgtgcttggctatatagaagttgccccagaaaacaaatgggaatcaaagggcgttatcaacaagtctccagccaaagaacttattgcgcgtttcgatagcgtagaaaaagtagatgccgagttaaccaagctagccgattattgggcaaatttgctttctacttacagcgtagaaagtggcgacgaaaagctagaccgcatggtaaatatttggaaccaataccagtgtatggtgacatttaatatgagtcgctctgcgtctttcttcgaatctggcattggccgtggtatgggcttccgcgattccaatcaggatttgataggctttgtacaccaagtacccgagcgcgcccgcgaacgcataattgatattgcttctactcagtttgaagacggttcggcctaccaccagtatcagcctttaaccaaacgcggcaacaacgcaattggcggcaactttaacgatgaccctctttggctaatcctttctaccaccgattacataaaagagactggcgatttctctattttagaagagcaagtgccttacgataatgatgcgagcaaagccacaagtcattttgaacatttaaagcgctcgttttatcacacggttaataatttaggcccacatggcttgccacttattggtcgcgccgactggaacgactgcctaaacctaaactgctttagtgaagaccctaacgaatcattccaaaccacgggcaacaaaaccggcagaacggctgagtcgttaatgattgcaggtttatttgttttatacggcaacgagtttgtaaaactgtgccgtgaaataggccaagacggagaagcggcagaagcccaagcccatattgaccaaatggtagaagctgtgaaaaagcacggctgggatggcgagtggtttttgcgtgcttacgactactacggtaaaaaagtaggcagtaaagaaaacgaagaaggcaaaatatttatcgaatcgcaaggtttctgcggcatggcaggaatcggcctagaagacggccttgtcgaaaaatcgatggattctgttaaagaatggttagattgcgattacggtattgtgttgcagcaaccggcgtttaccaagtactacatagagtatggtgaaatctccacctaccctgctggctacaaagagaacgcaggtatcttctgccacaacaacccgtggattatgatcaccgaaactttgcttggccgcggtgacaaagcctttgaatactaccgcaaaattgcacctgcatacctagaggaaattagcgatcttcacaaagtagagccttacgcctactgccagatgattgcaggtaaagatgcctacttacctggcgagggtaaaaactcatggctaacagggaccgcttcgtggaacttcgctgcaattactcagtacattttaggcgtaaaaccagactatagcggtttagcaattaacccttgcataccgtctagctgggatggctttaaagttacccgtaagtatcgcggcgcaacctataacatcatcgtaaccaacccaacccatgtaagcaaaggcgtaaaatcgctcaccctaaatggcaacgctattgatggctacatagtgccaccgcaacaagctggcaccgtatgtaacgtagaagttacattgggc

SEQ ID NO: 137 - DNA, 2364 bp, Saccharophagus degradans 2-40
atgttaaaagccattaacaacggcgaacgctatcaactcactagccctaccgctatgccgcaaagcgcatcgtttttatggaataaaaaaatgatgatacaagtaaattgccgcggctacgccgttgcgcaatttatgcagccagaaccagccaaatacgcttacgcacccaatctggaagcaaaaacatttatgcaaccagagcaaccctattacgcgcatcaccccgggcgctttttctatataaaagatgaagagacaggcgagattttttcggcaccctacgagcctgtgcgcagccagctgaacaactttagctttaacgcaggcaagagcgatataagctggcatattgccgctttaggcattgaagtagagctatgtcttagcctgccggtggacgatgtagtagaattgtgggaactaaaaataaaaaacggcggcgcgcaacctcgtaaactcagtatttacccgtactttcctgtgggttacatgtcgtggatgaatcaatctggtgactacagccaaaccgccggcggcattattgccagctgcgtaacgccttatcaaaaagtcgccgactactttaagaataaagactttaaagataaaacgttctttcttcacgaaaccgccccagcagcatgggaagtaaaccagaaaaacttcgaaggcgaaggcgggttgcacaaccccaacgccatacaacaagaaacgctgggctgcggcaacgcattgtacgaaacgcccacagcggtattgcaataccgccgcgaacttgcagcgcaagagcagcaaacctttcgctttatttttggcccagcatttgacgagagcgaagccattgcactgcgcaataagtatttatctgccgaaggttttgccaaagcaaaaagcgaataccaaacctatataacgagcggcaaaggctgcttgcaaattaacaccccagacccagaactaaacaactttgtaaaccactggctaccgcgccaagtgttttatcacggcgatgtaaaccggttaaccaccgacccgcaaacgcgcaattatattcaagacaatatgggcatgagctacattaagcccaacattacgcggcaggcgtttttacatgccttaagccagcaggaagaaagcggtgcaatgcccgacggcattttattgcttgaaggcgccgagcttaaatacataaaccaaataccccataccgatcactgcgtttggctgccggtgtgtatgcaagcctatttggatgaaaccaatgactacgccctattagacgaaatagtaccctatgcgagtggcgagaagcgcgaaactgttgagcaacatatgcatcacgctatgcgctggcttttgcaagcacgcgacgaacgcggcctaagctttatcgcacagggcgactggtgcgaccccatgaacatggtgggctacaagggcaaaggggtatccggctggctttcagtcgctaccgcttatgcattaaacctgtgggcagatgtttgcgaacaacggcagcaaaacagttgcgccaacgaatttagacagggcgctaaagatataaacgcggcggtaaacaagcatatttgggatggcgaatggtttggccgcggcattacagatgacggcgtactgtttggcaccagcaaagataaagaaggcagaatttttctaaacccacaaagctgggcaatacttggcggcgccgccgacgaacaaaaaatcccatgcctgctagacgcagtagagcaacaactggaaaccccttacggcgtaatgatgctggcccccgcgtttaccgccatgcgcgatgacgtaggccgagttacccaaaaattcccaggctctgcagaaaacggctctgtttataatcacgcggcggtgttttatatatttagcttgttatccattggcgagagcgaacgcgcatataaactgctacgccaaatgctgcctgggccagatgaagccgatcttttacagcgcggccaactgccagtattcatacctaactattatcgcggcgcatactaccagcacccccgcaccgccggtcgctctagccagctctttaatacgggtacagtctcgtgggtttaccgctgcttaattgaaggggtattcggcttgaaaggctcgccacaaggcttagttgtacaaccgcaactgcctgtcgcctggcaaacagcagaagccgttagggaatttagaggcgcaacgtttaacgtgagctaccgcaaaagcagcgatataaaagaaatggaaatacagctaaatgaatcggtaataagtggcaacaccatctccgacatcaccgccggcgcgacctatcaattaaccgttctattacctgccacacac

SEQ ID NO: 138 - DNA, 1371 bp, Saccharophagus degradans 2-40
atggtgaactacttaaagcgcgctgccctgtgcatgcttgcgctcgttgctgtggcttgcgccaaatcgcagccagaaacaaaagttgaagagctgcctgccaccaaaactgcggcaaatgccggtgtggcagcgacagagtttgtgcaagtaaatggtggccgctttacattgcgcgggcaggactacgcctacataggcactaatatgtggtttgccgcgtatattggttctaccaaccctgaatacggcgatcgcgagcgcctaattaaagaactcgatttattaaaatccttgggtgtgaccaacctgcgtattttaggagcatccgaaaaatctccattgcgcgattccatgaaaccggcaattagtgagcgcggtgaaattaaccagcacgatattttagagggcttagattttgcgttagctgaaatggctaagcgcgatatgaaagccgtgatatttctgaataacttttgggaatggtccggcggtatggcgacttacctaagctgggttaacggtggcgaaattgttgatatggcagaccccaccaaaccatggccagcttttgcacttttttcagcggggttttactctaatgaagaggcgaaacaactattcaataattaccttacaaaagttgtaagccgccgcaataccattaccggcgagttgtacgctaacgaccccactattatgtcttggcagctcgctaacgagccgcgcccaggtaacggcgatgtgagcaagtctaacttacccgcctattacgattggataagtaaaaccactcagctaattaaaagcattgcccctaagcagttggtgtcgattggtagcgaaggtaccatgggctgcttagagttggatgagtgcgttattaccgcccacaaagaaacaggtatcgactacgttacattccatatgtggcttaaaaactggggctggttcgatgtgcaaaacgcagagcaaacctacgacagcgcagttgctactgcagataaatatatcgatcaccacattaaactggctaacgagttaaatatgccggtggtgctggaagagtttggtatggagcgcgacggaggtgaattctccccagaaagcgcggtaacctatcgcgataaattctatgcctatgtgttcgatcgccaaattaaaagtattcgctctggcgggccgtttgtagggtccaacttttgggcgtggggcggttatggcaaagccatgcacgatgatgctgtatggcgcaaaggcgataaaacctttgttggtgacccgccgcaggagccgcaaggtttaaatgcggtatttgcttccgatacttcaacgctggaagtgttgaagcaagcggcggacgctattcgg

SEQ ID NO: 139 - DNA, 2463 bp, Saccharophagus degradans 2-40
atggttgtgaatacagacattacacaatggtcgcttactaaaactaatgcgaatggcgcccaaacccccgctgatattattccccttcagcaatggcttgctgtaccagtgcctggaaccgtggcgcaagctgtgggcgatgctggcccgcaagaagaccttgagcaatttgattggtggtacaccgctcaatttccactgcccaaaacaggtaagcgcacttatttgcagtgcgacggtttggcaaccctaagcgaagtgtgggttaacgaccagcaggttttatactcgcaatcgatgtttgaaaaccacaagctcgacattaccgattacctgcaagccgacaatacactggccatagtgtttaaagcgctcgcaccacatttggccgagcgtcgtgcaagaccgcaatggaaaaccaacctagttgataaccaaaacttgcgctggtttcgcactagcttattagggcgtatgccgggctggacaccacccgtaaaagcgataggcccgtggcgagatattagtattgttagtgtggctaaatttgatttagtggagtgcactgtgtttagcgaagtggatgaggcgctaaatggcaaggtacatataaacttagaattagattttatcgatgctaaattggcagccgacccacaaatacaatttttattagacggcaaaatctaccccataaccgcaaaacctattaaaggtggcggcgcatttatagataccgaaatagctattgagcaaccgcaattatggtggccccatacccacggcgagccctacctacacgcttacaaaattaccgccattatagatggtgaagtaacaaccttaaccgaaggtaagttgggctttaagcgcgtaactgctgctaatcaaacaaatcaattggcgcttgaagtaaacaacaacaaaatattttgtcgcggcgcctgttgggctactccaaatataactagtttaaatgcatctaagcaggagtatcgccatctattaaaactattagtagatgcaggtgcaaacatggttcgcattggcggtaccatggtgtacgaacacgacgatttttatgccttgtgcgatgagctaggtatattggtttggcaagattttatgtttgccaatatggattacccctttgcagatgaagattttagtaagcttgttgcaaaagaagtgcgccaacaaattacgcgcttaaaacaaacagcctctattgcagtattttgcggcaacagtgaaatgcagcagcaagcggccatgatgggtatggagcagacacaatgggcgaacgcactgtttgatacttttataacgcaaaaattagaagagcagcagttaacgcttccttattttacttctagcccctgcgaaggtggtttgcctttccataccgacgccggtttaacgcattactatggtgtgggcgcctataaacttatgcccgaccattttactgtgcgcgaagttggttttacttccgagtgcttagggttttcgcatataccggtaacagcttctttaaagcaagcttttgaatcaccataccccgccacccatacacccagctggaaggccggcatacctagggataacagcgcgggttgggatttcgaagatattcgcaacttttatttagaaaaaatatttggcgtagttgccgatactcttcgctatagcgacccagaaacctattttaaacttgccaccattgctactgcagaaatggtaagtagcgtgtacagcatatggcgcgcgagtatatcaaattgcaatggtgcgctggcttggttttatcaagatattgttgcgggtgcaggctggggaatagttgatagttttgcgcggccaaaagcagcgtattactttttaaaacgagtatggcagccgcagcaggtattgcttataaacaacagcttgaatggctatacgctagaagtgcaaaatgaaacagcgcatacacttcaagcgcagctcaatattgtattggttggcttaagcgataatattgttgcagagcatacgcaagaaattacgctcgcagcgaatagcgttggcacacacaagctagataccgtttttggccgttttatggatgccacccatgcctataagtttggccgccaaactatttatgctgtagtagccgagctgcgaaacgaaagcggcgaacttattagtcaggcggtatcgttcccgggttgtaggcgcatcaacaccggcgccggtgaaataacgggtagcattactagcgatagcgataatgaatcagtggtaacgttaacgcccagcgtttttgttgagtacgcgtgtttagaatcaaaaaccacacaattcagtgataactacacctgcatgttgccaggtaagacgtatagctttaaagcgtgtgaacaaatcaaaagcgtacatgtatctactcttaacctacaaaaagaatttagagtgaca

SEQ ID NO: 140 - DNA, 696 bp, Bacillus subtilis
atgaaaaagatcatgagtgcatttgttggtatggttttgttgacgatcttctgtttttccccgcaagcttcggcagcatatgacgacctgcatgaaggttatgcaacgtatacagggtcaggctattcaggaggagctttcctgctggatcccattccttccgatatggagattactgcaataaatccggcggatctcaattacggaggagtaaaagcggcacttgccggctcttatttggaagttgaagggccaaaagggaaaacaaccgtatatgttactgatctttatcccgaaggcgctcggggagctcttgatctgtcacctaatgccttccgtaaaatcggcaatatgaaagacggaaaaatcaatattaaatggcgtgttgtcaaagccccaatcaccggcaatttcacgtaccggatcaaagaaggcagcagcaggtggtgggcagcaatccaagtcagaaatcacaagtatcctgttatgaaaatggaatatgaaaaggatggtaagtggatcaacatggagaaaatggactataaccattttgtgagtacgaatttaggtactggctctctcaaagtcagaatgactgacatccgcggaaaagttgtgaaagacaccattccaaagctgcctgaaagcggaacgtccaaagcctatacagtaccgggccatgttcagtttcctgaa

SEQ ID NO: 141 - DNA, 1497 bp, Bacillus subtilis
atgaaacggtcaatctctatttttattacgtgtttattgattacgttattgacaatgggcggcatgatagcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagagatgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagcctttacggaaacacgccaaacgtcatttatgaaattgcaaacgaaccaaacggtgatgtgaactggaagcgtgatattaaaccatatgcggaagaagtgatttcagttatccgcaaaaatgatccagacaacatcatcattgtcggaaccggtacatggagccaggatgtgaatgatgctgccgatgaccagctaaaagatgcaaacgttatgtacgcacttcatttttatgccggcacacacggccaatttttacgggataaagcaaactatgcactcagcaaaggagcacctatttttgtgacagagtggggaacaagcgacgcgtctggcaatggcggtgtattccttgatcaatcgagggaatggctgaaatatctcgacagcaagaccattagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccatcaaaagataaacccacacaggaaaatggtatttctgtacagtacagagcaggggatgggagtatgaacagcaaccaaatccgtccgcagcttcaaataaaaaataacggcaataccacggttgatttaaaagatgtcactgcccgttactggtataaagcgaaaaacaaaggccaaaactttgactgtgactacgcgcagattggatgcggcaatgtgacacacaagtttgtgacgttgcataaaccaaagcaaggtgcagatacctatctggaacttggatttaaaaacggaacgttggcaccgggagcaagcacagggaatattcagctccgtcttcacaatgatgactggagcaattatgcacaaagcggcgattattcctttttcaaatcaaatacgtttaaaacaacgaaaaaaatcacattatatgatcaaggaaaactgatttggggaacagaaccaaat

SEQ ID NO: 142 - DNA, 1266 bp, Bacillus subtilis
atgattccacgcataaaaaaaacaatttgtgtactattagtatgtttcactatgctgtcagtcatgttagggccaggcgctactgaagttttggcagcaagtgatgtaacagttaatgtatctgcagagaaacaagtgattcgcggttttggagggatgaatcatccggcttgggctggggatcttacagcagctcaaagagaaactgcttttggcaatggacagaaccagttaggattttcaatcttaagaattcatgtagatgaaaatcgaaataattggtataaagaggtggagactgcaaagagtgcggtcaaacacggagcaatcgtttttgcttctccttggaatcctccaagtgatatggttgagacctttaatcggaatggtgacacatcggctaaacggctgaaatacaacaagtacgcagcatacgcgcagcatcttaacgattttgttaccttcatgaagaataatggtgtgaatctttacgcgatttcggtccaaaacgagcctgattacgctcacgagtggacgtggtggacgccgcaagaaatacttcgctttatgagagaaaacgccggctcgatcaatgcccgcgtcattgcgcctgagtcatttcaatacttgaagaatttgtcggacccgatcttgaacgatccgcaggctcttgccaatatggatattctcggaactcacctgtacggcacccaggtcagccaattcccttatcctcttttcaaacaaaaaggagcggggaaggacctttggatgacggaagtatactatccaaacagtgataccaactcggcggatcgatggcctgaggcattggatgtttcacagcatattcacaatgcgatggtagagggggactttcaagcttatgtatggtggtacatccgaagatcatatggacctatgaaagaagatggtacgatcagcaaacgcggctacaatatggctcatttctcaaagtttgtgcgtcccggctatgtaaggattgatgcaacgaaaaaccctaatgcgaacgtttacgtgtcagcctataaaggtgacaacaaggtcgttattgttgccatcaataaaagcaacacaggagtcaaccaaaactttgttttgcagaatggatctgcttcaaacgtatctagatggatcacgagcagcagcagcaatctacaacctggaacgaatctcactgtatcaggcaatcatttttgggctcatcttccagctcaaagcgtgacaacatttgttgtaaatcgt

SEQ ID NO: 143 - DNA, 1539 bp, Bacillus subtilis
atgaggaaaaagtgtagcgtatgtttatggattctagttttattattgagctgcttatctgggaagtctgcgtatgctgccactagtactacaattgcaaaacatatagggaattcaaatccgcttatcgaccatcatttgggagcggatccggttgcgctgacctataacggaagagtctacatctatatgtcaagtgatgactatgaatataatagcaacggaacaattaaagataattcatttgccaatttgaatagagtattcgtcatatcttcagcggatatggtgaactggacagaccacggagccattccggtagcaggtgccaatggagctaatggaggccgtggaattgcaaaatgggcaggtgcgtcatgggcaccgtcaatcgcagttaaaaaaattaatggcaaggataaattcttcctttatttcgcaaacagcggcggaggtatcggggttctcaccgcagacagcccgattggtccatggaccgacccaatcggaaaaccgctcgtaacgccaagtacgccaggaatgtctggtgttgtatggctttttgatccggcagtatttgtagatgacgacggaaccggttacctgtatgccggcggaggcgttcctggcgtttcaaatccaacgcagggacaatgggccaatcctaaaacggctagagtcataaaattggggcctgatatgacgagtgttgttggaagtgcatctacaattgatgcgcctttcatgtttgaagattcgggattgcacaagtataacggaacatattattactcctattgcatcaatttcggcggcacgcacccggccgataaacccccgggtgagatcggctacatgaccagttcaagtcccatgggtccctttacatatagagggcacttcctgaaaaatccgggtgcatttttcggaggtggcggaaacaaccatcatgctgttttcaattttaaaaacgagtggtatgtggtgtaccatgcgcaaactgtcagttccgctctgttcggggccggcaaaggataccgctctccccatattaataagctggtgcataatgcagatggatctattcaagaggtagcggcaaattatgcaggtgtaacacaaatttccaatttaaacccatataaccgggtagaagctgaaacgtttgcttggaatggacgcattttgacagagaagtccacagcacccggcgggccagtaaataatcagcatgtaacaagcattcaaaatggagactggattgctgtaggaaatgcagacttcggagcgggcggtgccaggtcatttaaagcaaatgtagcatccactttaggcgggaaaatagaagtgcgcctcgacagtgcagacggtaagcttgttggaactctgaatgtgccttcaacaggcggagcgcaaacgtggagggaaatagaaactgcggtaagcggggcaaccggtgtgcacaaagtattctttgtatttaccggaacaggtacaggaaacttgtttaattttgattactggcagtttacgcaaaga

SEQ ID NO: 144 - DNA, 639 bp, Bacillus subtilis
atgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaattttgttgttggtaaaggttggactacaggttcgccatttaggacgataaactataatgccggagtttgggcgccgaatggcaatggatatttaactttatatggttggacgagatcacctctcatagaatattatgtagtggattcatggggtacttatagacctactggaacgtataaaggtactgtaaaaagtgatgggggtacatatgacatatatacaactacacgttataacgcaccttccattgatggcgatcgcactacttttacgcagtactggagtgttcgccagtcgaagagaccaaccggaagcaacgctacaatcactttcagcaatcatgtgaacgcatggaagagccatggaatgaatctgggcagtaattgggcttaccaagtcatggcgacagaaggatatcaaagtagtggaagttctaacgtaacagtgtgg

SEQ ID NO: 145 - DNA, 1599 bp, Bacillus subtilis
atgaagattaccaatcccgtacttaaaggattcaatcccgatccaagtatttgtagagcaggagaggattattatatcgctgtatctacatttgagtggtttccgggagtccagatacaccactcaaaagatttagtaaattggcacttagttgcacatccattacagagagtttcacaattagacatgaaaggaaacccaaattcaggtggagtttgggcaccatgtttaagctatagtgatgggaagttttggctgatctatacggatgttaaggtagtagatggcgcatggaaagattgtcacaattatttagttacttgtgaaacgattaatggtgattggagtgagccgattaaattaaatagctcggggtttgatgcttctttgttccatgatacggatggaaaaaagtatttattaaatatgttatgggatcaccgtattgatcggcactcatttggaggaattgttatacaggaatattctgataaagagcaaaaattaatcggtaaaccaaaagttatatttgaaggaactgatagaaaactgacagaagctccgcatctttatcatatcgggaactattattatttattaactgcagaaggaggaacacggtacgaacatgctgctacaattgctcgttctgcaaatattgaggggccatatgaagttcatcccgataatccaattttaacgtcatggcatgacccaggaaatccattgcaaaaatgtggtcatgcatccattgttcaaacacatacagatgagtggtatttagctcatttaacgggacgtcctattcatcctgacgatgattcaatttttcagcagagaggatactgtcctttgggcagagaaacagctattcaaaaactttactggaaagatgaatggccctatgtagtaggtggaaaagaaggaagcttggaggtagatgcaccttctatacccgaaacaatatttgaagcaacgtacccggaagttgatgaatttgaggattcaacattaaatataaattttcaaactttaaggattccattcacgaatgaattaggttcattgactcaagcgccaaatcatttacgattattcggtcatgaatcattgacctcgacatttactcaggcatttgtagccagacgctggcaaagtctccattttgaagccgaaactgctgttgagttttatccggaaaattttcaacaagccgctgggttggtgaattactacaatacagagaactggacggctcttcaagtcacgcatgatgaagaacttgggcgcattcttgaattaacaatatgtgacaacttttctttttcacagccattaaataataaaattgttattcctcgtgaagtaaagtatgtatatttaagagtaaatattgaaaaggacaaatattattatttctattcttttaacaaagaagattggcacaaaattgacattgcactggaatcgaaaaaattatcagatgattatatccgtgggggaggattcttcacaggggcctttgtagggatgcaatgccaagataccagtggtaatcatattccggccgactttagatattttcgttataaagaaaaa

SEQ ID NO: 146 - DNA, 2955 bp, Clostridium phytofermentans
atgaaaaagataataagtcttttattagtgataacacttctgatatccatggcaccatcgaaagctgacgcagcggaaaccaattataattacggagaagctcttcaaaaatcaatcatgttttatgagtttcaacgttctggtaaactgccaagtaccattcggaataattggagaggtgactctggtttaaccgatggagcagatgttggtttggatctaactggtggctggtatgatgctggtgatcatgtaaaatttaatcttcctttggcttatactgtaacaatgttagcatgggcagtatatgaagaagaggctactctttcaaaggcaggccaattaagttatttattagatgaaattaagtggtctagtgattacctaattaaatgtcatccacaagcaaatgtattttattatcaggttggtaatggaaatacagatcactcttggtggggacctgctgaagttatgcagatggctagaccgtcctataaggttgatttaaataacccaggttctactgtagtaggagaagcagcagcagctcttgcagcaacagcacttatatataagacaaaagaccctacttattcagcaacttgccttcgtcatgcaaaagagctttttaattttgcagatacaacaaaaagcgatgctggatatacagcagcaagtgggttctatacttcctatagtggattttatgatgaattatcctgggcagctacatggatttaccttgcaagtggagaagcgacctatttggataaggcagaatcttatgtagccaaatggggaacagaacctcaatcttccacattaagttataagtgggcacaaaactgggatgatgttcactatggtgcagctttattattagcaagaattacaaataaagcaatttataagaacaatattgaaatgcatcttgactattggactacagggtataatggtagtcgtattacttatacaccaaaaggacttgcttggttagattcctggggtgcattaagatatgcgacgacaacagcatttctagcaagtgtttatgctgattggagcggatgtagtgctggaaaagttagtacttacaatgcatttgcgaaacagcaggtagattatgcattaggaagtaccggaagaagttttgtggttggatatggtgtaaattctccaacaagacctcatcatagaactgctcatagttcatgggcagacagtcagacggagccaaattaccatagacacaccatttatggtgctttagtaggtggacctggtaataatgatagttatgaggataacattaataattatgtaaacaatgaaatcgcttgtgactataatgcaggttttgttggcgcattggctaaagtttataaaacatatggcggaacaccaattgcaaactttaaggcaatcgaaacagtaacaaacgatgagttatttattcaagctggtattaatgcctctggtccatcttttatcgaagtaaaggcattggttttcaatgagacaggttggccagctcgtgttaccgataaattatcctttaagtattttattgatatctcggaatatgtagcaaagggatatacaaagaatgattttacggtatcgacaaattataacaatggagcaaccacatcggcattgcttccttgggatgctgcgaataatatctattatgtgaatgtagacttctctggaactaagatttatcctggtggacagtctgcatataagaaagaagtacaatttagaattgctggtccacaaaacgttaatatatgggacaattccaatgactactcctttacacaaattgctaatgttagttcaggaaataccgtaaagaccacatatataccattgtatgataatggtaaattagtatttggtaatgagccaaagacgggtgttccttctgcaagtcttgataagactacagcaaactttgacaaaaacccagctgtatccgcagatataccagtaaccattaactataatggtaatacattaacagcggttaagaatggaacaacggttttaacgaaaggtactgattatactgtatctggtaatgtagtaacgttatctaagaattatttcttagcacagagcgctagtacggttactttaacatttgtatttagtggcggtaacgatgcaacattaaaagtgactttagtagatacttctccaagtgcatccattaatccaaattctgctgtctttgataaggctagcggaaaacaggaaaatatagttattacgcttacaccaaatggcaataccttagctggacttaagaatgggtctaagagcctggtaactggaactgattataccgtttccggaacaacagtgacgattctatcttcttatttaagtcaatttgcagtaggaagtcaatctattgtatttgaaatgaataaagggacaaatccagtcttagcagttaccattaaggattcttctgttgttactccaacaggaaatattaaacttcaaatgtttaatggaaattcttctgcaacaacgaatggcattgcaccaagaattaaattaattaacaccggaactactgcaatcaacttatccgatgttaagattcgctattattatacaatcaatggcgaaaaggatcaggcattctggtgtgattattcgacgattggtagttccaatgtaaatggtactttcgtaaagatgagtacaccaaaaacaaatgcagattactatctagaattttcatttaagtccgctgccggaactttaaacgcagggcaaagtattgaagttcaaggaagattttctaaggtagactggacaaactatacacaaacagatgattattcgtttggtgatagtaactcaagttatgctgattggaataagacaacagtatatatctctgatgttttggtttggggagtcgaacca

SEQ ID NO: 147 - DNA, 2757 bp, Clostridium phytofermentans
atgcaaaaacgtatctacaagagagtagcagcagccattatgaccgctgcaatggtagttactctagttcctcagggagcaaagacatccgctttggctggtgaaactgagcaagctttagcggcggcagcaacaaggggaacctatgagcaacgttttatggacttatggtcggatattaaaaacccaaagaacggttattttagtcctcagggaattccgtatcattctattgaaacaatgattgtagaagctcctgattatggtcatgtaactactagtgaggcaatgagttactatatgtggcttgaagctatgtacggcaagtttacaggtgacttttctggatatgggaccgcttggaatgtagcagaaaaatatatgattccaacggatgcagatcaaccaccaaccagtatgagtaagtatacaccgagtaaacctgcaacttatgcacctgagtatcaggatcctagtcagtacccagcgaagctcgattcgagtgctcctgttggtagtgacccaatttggtcacagcttgttgcagcttatggacggaatacaatctatggtatgcactggttactagatgttgataactggtatggatttggttctaggggagacggaacctcaaaaccatcctatatcaacacattccaacgtggagaacaggaatcaacatgggaaacaattcctcagccatgctgggatacaatgaaatatggtggaacgaatggtttcctcgacttattcactggcgatagttcctatgcacagcaatttaagtatacggatgcaccagatgctgatgcaagagcaattcaggctgcttattgggcaagtgaatgggcgaaagattatggtgtaaatgtcgatacttattcatcaaaagctacgatgatgggcgattatcttcgttattccatgtttgataaatattttagaaaaataggtaattctacagttgctggtacaggatatgatgcatcacattatctgttatcctggtattatgcttggggcggtggaattacagctgattgggcatgggttattggatctagccataaccactttggttatcaaaatcctatggcagcttgggttttatctcaaaattcgaagtttaaaccaaaaactacaaatggacaggctgactgggcaacaagccttactagacagcttgaattctatcagtggttacaatcttcagaaggtgggattgccggtggtgctagtaactcaaagaatggtcgttatgaaacttggccagctggaacagctacattctatggaatgggctatgaagcaaacccagtttataaagatccaggaagtaatacctggtttggtttccaggcatggtcaatgcaacgtgttgcagaatattattataagacaaatgatgtaaaagcaaaacagatcctagataaatgggtagcttgggttaaatctgtggttgtattaaaagcagatggaacctttacgataccaagtacacttgactggagtggtcagccagatacatggacaggctcctatactggaaactctaagcttcatgtgacagtggttgattctggtaccgaccttggcgttacaggatctcttgcaaatgctttgttatattatagtaaagctgcaaacgatgtagctgcaaagaacttagcaaaagaattattagatcgcgtatggaaattatatcgtgatgataagggcgttgctgctcctgaagcacgtgcagattataagagattctttgagcagaccgtttatgttccaagtacctttaatggtaagatgccaaatggtgatgtgattaagtctggtattaaattcttagatatccgttctaagtatttacaagacccatcttatccaaagttactggcagcatatcagagtaataagtcaccagagtttatatatcatagattctgggctcagtgtgatgtagcgcttgcaaatggtgtatatgcactcctttatgagaatggttctggcactactgattatgctaatattaatcctacaaatggttcctttgataaagctgtaggaaaacaagcagatcttagtacaacattatcaatgcaaggttatacctttgttaacttaagtaaaggtactacacctctgactttaaatacagactatactgttaatggtactacagtagtccttaagaaagaattcctatctacattaccacttggtgatactacaattacttttaattttagcaattcttatacaaaaccttttgtagtaaccgttgtggatacaacagtagttgtggtagtaggagatgttaaggttcagatgttcaatggaaatactagtgcaacaacgaatggaattgcacctcgtttttatcttgtaaatacaggctctaatagtattaatctttctgatgtaaagcttcgttactactatacaattgatggtgagaagagccagagtttctggtgtgattggtcatcgattggaagcagtaatgttaccggaacttttgtaaagatggcaactccaaagactggagcagattattatcttgagattggatttacaagtggtgctggttctttaaaggcaggacagggaatcgaagttcaaggtagattctcaaaaactgactggtctaattatacccagactggggattattcatttaatagcagcggtaactcctatgttgattggaacaaggcaactgcttatataagtggaaaacttaattggggtatcgaacca

SEQ ID NO: 148 - DNA, 1407 bp, Clostridium phytofermentans
atgtgtgttgaattgatgagaaagtttccaattatagtatcaggtattttagtatgtgcaacattattaagtggctgtagccaaaatatgtcaaatgttgataaatccacagtgaatttgaattcgcagaatacagacaatcaaaatcaagatgcaaataataaagactcggataatcaaggcgcaaataatcaagagtcaaataatcaagaatcacaaaaccctgaattaaaaaatacaccaacacctcaaatcatagtactaccaggtgacagcacaattgaagcaaacgaaattgtagccccaaccatcacatttgaacaaaaagaaataccatcgaatccagcaataacttttgtacataatatgaaaataggatggaaccttggaaatacatttgacgcagtgagtgattccaatctaatggatgaacttaattatgaaagctcatggtgtggtgtaaaaacaacagaagagatgatgaaagcaattaaagatgctgggtttcagtcgattagaataccagtatcgtggcacaatcatgtttctggtgatgattttattataagcgaagtatggcttaaccgagtacaagaagtggtcgattatgctatcaataatgatatgtatgtgatattaaatactcaccatgatgtaagtaaaaatttttattatccaagtaatgaaaatttagaatcttctaaaaaatatatcaacgcagtatggacacaagtaagtgaacgattttcttcctatggagaaaagttattatttgaagggatgaacgaaccaaggcttgcaggttctaattacgaatggtggttagatttatcaaagcctgagtgtaaagaagcaatcgaatgtattaatcaattaaatcaggaatttgttgataccgttcgcaaatcgggaggagagaatacttctaggtatcttctgataccagggtatgatgcatcgtctcaatatgcacttattaatgattataagttaccaaaagataatataaatgatcgtttaattgtatcagtacatgcatatctaccatatgactttgccctaaaaagtccaaaggaaagtggcagtatatcagaatggaattcaaaaatagctggatgtactaaggagatagattcttttttaaatagtttatatatgaagtttataaaaaatggagttcccgtaattatcggtgaatttggtgccagagataaagaaaataatttagaatctcgggtagagtatgctacttattatataggtgctgcaaaagcgaatggaatcacatgcttctggtgggataatcatgcatttaaaggggacggggaaaacttcggtctttttgatagaaagagttgtactataaaatatcctgagatattgcaaggtttaatgaaatacgcagaa

SEQ ID NO: 149 - DNA, 2229 bp, Clostridium phytofermentans
atgaaaagaaaactgaaacaaagatgtgctgttttagtggcagttgcaacgatgatagcttcgttgcaatgggggagagtgccagtacaagcagtaacagcagacggtcttacctctcaacagtatgttgaggcaatgggcgaaggctggaacttaggaaattcctttgatggttttgattctgatacttcaaaaccagatcaaggcgagaccgcttggggaaatcctaaggttacaaaagagctaatccatgcagtcaaacaaaaaggctatagtagtatccgcataccaatgaccctatatcgtagatatacggagagcaatggtgtatgcactatcgatagcgcatggatagcacgttacaaagaagtagtagattatgcagttgcagaaggtttatacgttatgataaacattcaccatgattcctggatatggttatcttcatgggatggaaataagagttctgtgcaatatgtaagatttactcagatgtgggatcaacttgcgaaggcatttaaagattatccgttacaagtatgttttgaaacgataaatgagccgaactttcaaaactctggaaacgttactgcacagaataaattagatatgcttaaccaagcggcttacaatataattcgtgcctctggtggatcaaatgcaaagagaatgattgttttaccatcactaaatacgaaccatgataatagtgtaccattagctgatttcataactaaattgaatgattctaatatcattgcaaccgttcattattatagtgaatgggtatttagtgctaaccttggtaagacaagctttgatgaagatttatggggaaatggtgattacactcctcgtgatgcggtaaataaggcgtttgataccatttccaatgcatttacagcaaaaaaaatcggtgttgttatcggagaatttggtcttttaggttatgactctgattttgaaaataatcaaccaggcgaagaattaaaatattatgagtatatgaattatgtagctagacaaaagaaaatgtgccttatgttttgggataacggatctggaattaatcgtaacgactctaagtatagttggaaaaaacctatagttggaaagatgttagaagtatctatgacaggacgttcctcttatgcaacaggccttgataccatttacctaaacggcagctcatttaatgatattaatatcccgcttactctaaacggtaacacctttgttggagttacaggattaaccagtggtaccgattttacgtataaccaatccaatgcaacactaacattaaaatcatcctacgtgaagaaggtttatgatgcaatgggaagtaattatggtacggtagctgatttggtacttaagttttcaagtggagctgattggcatgagtatttagtgaaatacaaagcaccagtatttcaaaatgcgaatggaactgtttccaatggaattaatattccagttcaatttaacggaagtaaactccgtcgttctacagcttatataggttctaatcgagttggcccgaatcaaagctggtggatgtatttagagtatggtgcaacttttgtggcgaactatacgaacaatattttaaccattaagcctgatttctttaaggatggttctgtttatgatggaaatatatcatttgagatggagttttatgatggacaaaagttaaaatataatcttaataaatcaaatggtaacataacaggaactgcagcagcagtaacccctacaccaacaccaacggcgacaccaacaccaacagcgacgccaacaccaaccgtaacaccaaaaccaacaataaccccaacagtaacgccgacaccaacagtaacgccaaaaccaacaataacaccgacagtaacaccaactcctactccaatcccaggaacaggtccagttacattaaaatacgaagtaacgaatacttgggataagcatacacaggcgaatattacattaaccaatacctctaatacagcactaaagaattttgttgtatcatttacttataaagggtatatagaccaaatgtggagtgcagatttggttagtcaaaattcgggtaccattacagtgaagggaccagcatgggctacgaatctagatccagggcaaagtataacatttggttttattgcttcacatgatacaccgtctgttgatccaccatcaaatgttactttagttagttcaaat

SEQ ID NO: 150 - DNA, 1404 bp, Clostridium phytofermentans
atgagtaaaatcagaagaatagtttcattgtttttgattgtaacaatctttatcacgacatgcttttttaatgttggtcaaaaggtatatgctgctgatacgaataatgatgattggctacattgtgtaggcaataaaatttatgacatgaatggcaatgaggtttggctgaccggtgcgaattggtttggttttaactgtactgaaaatgtatttcatggtgcatggtacgatattaaggggatgttaactaatattgcaaacagaggaataggatttttaagagttccaatttcaacggaacttttgtatagttggatgataggcaaacctaataaagtttcaagtgtgaccgctgtcaataatccaccttattatgtatgcaaccctgatttttatgatcctacaacaaatagtgttaaaaatagtatggaaatatttgatatcattatgggatactgcaaacaattggggatcaaagtaatggtagatgttcatagtccggatgcaaataattcaggtcataactatccgttatggtatgggttaactacgactactgcaggtgaaataacgacagataagtggatcaatactcaagcatggctggctgataaatacaaaaatgacgatactattctggcatttgatataaaaaatgaacctcatggacagaggggatatagtactacaacacctactaatatagcaaaatgggataattccacagatgagaataactggaagtatgcggcggaaagatgtgcgaaagctatacttgctaaaaaccctaaattattaattatgattgaaggtgttgaacaataccctaaaactgaaaaaggttataactataatacaccggatgtatggggagctactggtgatcagtctccatggtatagtgcttggtggggtggaaatttaagaggagtaaaggattatccaattaatataggcactctcaatagtcagatcgtctattcccctcatgactatggtccttccgtatacaaccaaccatggtttgataaggattttacaactcagaccctattagatgattattggtataatacttgggcatatattaaagataaaggtattgcaccacttttgataggtgagtggggaggttttatggatggtggaaagaaccagaaatggatgacattattaagagattatatagtaaataatcgtatccaccatacattctggtgtatcaatccgaactcaggggatactggaggtttactaggatatgattggcaaacttgggatgaagcaaaatacgctttattaaaacctgcattatggcagtcaaatggtaaatttattggtctagaccatcagacacctcttggtgtaaatggtatatcattagggcaatattatggaaaa

SEQ ID NO: 151 - DNA, 2916 bp, Clostridium phytofermentans
atgggtaatgcatcatatcttgaaacaccattatgggataatagtttacctcttaagaaaaggttagattatctcgttgaaaacctgacattggaagaaaaatttgagtttctagggacaggatgtccgacgattgaacgccttggaatacaaagtacctttcatggaggagaggctgcgcatggtatagaagcaagacacgaccagtcatttaataaaggagagccggaaccaacgacaatatttccgcaaccgattggaatgagctctacttgggatacgacacttttaactaagattggcgtaacagttggtaatgaagctagagttttatatcaacgtcacaaaaatggaggtttgtgccgttgggcgccaacgatagacatggaacgtgatccacgttggggacgaacagaagaagcttatggggaggacccctatcttacagggaagatggcttctgcatatattcaaggtatgcgtggagttgatccgttttatattcgttgcggtgcgaccttaaagcatttctacgctaataatacagaaaaggatagaattttttcatcctcttctatcgaccctagaaataaacatgagtattatttagaacctttcaaacgtgcaattacagaggggaaagccgaagctattatgacggcatacaacgaaattaatggagtcccttgtattgtaaataatgaagtaaaaaacattgtaaaagaacagtgggggcttcgtgggcatgttgtatgtgatggtggtgacatgatgcaaacagttagtgatcataaatattttggctcccatgcagaaaccattgcctatgggttaaaagcaggtattgattgtttcactgataatcgtgaagtggttaaacaagcagccaaagaagcttatcaagccgggttgattacagaggcagatttggatacctcgatttgtaattcattttcaaccagaatccgtcttggttattttgatgcgataggacaaaacccatatgcacatataaccgaaaaatatattaatagtgaagagaataaatctttaacgctagaagctgcaacaaaagccatggtattattaaagaatgaaggacagatattgccacttactaaagaaaattcatccttttgtgtgatcggtccattatccgatgtttggtataaagattggtatagtgggataccaccatattccgtaacaccattacaaggtatcaaagagtacaacaaagggactcgtaagaatcttacgaattctaaggtggtggatggattacctcgcgttagaattcgatatcaagagaaatatctttgtgtaacagaggaaggttttgtcacactagggagtaaagaattagcagagacatttactatcacagactggggtaacggaaatctgaccatagcgactagtcaagggaaatacctgtcagcagatgaggaagaaggacttattactgcaactaagacggaagtatttgaatggtttgtaaaagaagcatttgatttccatcttgtgggtaatttaggcgaaaaaagttttcaaactatatttgaaattctaagtgaacaaaaaagacaggaaatatccgtaacaatagatacttggaaggatgattatgtagcgattaataaggaaggaaagctttcattttctaaggaagaaaaagttacattggatcttgaacttgtatccgatggtatcgaagaagcgaaagaatatacaaagaatagtgattatgctattctagtaatgggttgtaatcctgttattaacagtaaagaagaaattgatcggaatgatttagatctaccgccatatcaagaaagattaataaagcaagtacataaagtaaatcctaaggtaattcttgtacttataacaaattatccatatgcaatacgctgggaaaaggaacatattccggcaattataacgactacatctggaagtcaagaacttggtaatgcgattgctgctgtgttatttggtgatgtatcaccatcgggtaggttgccaatgacttggtatctcgatacgaaggatttaccaccgatagaggattatgatattattcgcggtaaccgaacttaccagtattttaacaaagaggtgttatacccatttggacatggtcttacctatacaactatgcaatatcaaaagcttacagtgcaattagaggattttactaatctattaattaaagtaactattgcaaatacaggaaatagaattagtgatgaagtggtgcaggtttatgtgaggcaggaagtctcaagaactgttagacctcgtttgcagctaaaagcttttgagagagtaaagaatatcttacctggagagaagagggagatagaatttataatttctaccagtgatttaacctattatgatgtagtaaatggtggtatgatattagaagaatctgagtatacaatcttagttggggcatcttctgaggacattagactacgcgaaacagctttcattcctggagtgaaagtgggatctcgaaatcttaggaaaaagattttagcggatcattatgacgactgcaggaattcgtacctacaccgtggaagcttaggtgatactgcggttgttgttaagaataaaactgaagcagcgatacttctttaccgagatgttagaatagaagaaaagccaattaaatttcattctaccgttcaatgtgtgggtgaaggaagtctgatagtttcatacattaagcaaagtgatgtagcgagttccgaggtaaaactaggtgatattactttagagaatcaagataagttttgtgatgttatcataccaattaactgggatagaataacatgcaatgaagtcattacattaaaaattacattgttagaagagatgaaattatcctctttctatgcagaa

SEQ ID NO: 152 - DNA, 1551 bp, Clostridium phytofermentans
atggacttatcaataagaggaaaagttggacaacgaattgtagcaggatttcctggtactacgatcgatagtgaattagaggattttatccgtacctataagattgggaatttcattttatttaaagaaaatattgtagatgcgaatcagttaagtaatctatgtgagggattacagcagcttacaaaaaaatataccggacatagagcatttataacgatagatcaagagggtggaatggtaacaagactatccgaagatagtgttaatattcctggtgcgatggcgattgctgcaactagggatgaaaaaaatgcttatatggcaggaaggattactggtcagcaattgagaaccttagggtttaactttgatttagcacctgtggcagatatcaattccaatatggataatccggtcattggggtaagaagttatggtgatgaaccagatcaggtagcaaaatactgcgtagccatgatgaaaggtcttaccgatggaggggtgctggcttcagcgaagcatttcccagggcatggagataccaatgtagattctcatcttgggttaccgaaggtacataagtcattagaggagatggagctgtgcgaattagtttcatttaaagcattgattgaggcaggaataccggcaatcatgtcatcccatatcattttcccagccttagaagaggaacttccagcaacgatgtcaagaaagattatcacaggactcttaaaggagaagcttggatttaaagggttagttattagtgactgtatggaaatgagtgcgattaagaaatactatggatcaattgagggaatcaagcatgcgattgaggcaggtgttgatttaatctttgtatctcataccatgagtgtcgcaagggaagcctcagatgtattgacaggcttgtatgaaaaaggcgaattatctatggatgagatggatgcatctattgataaaattatgtactataaagataaatgtttatgcaatgagaacgaaaagcatgataccaatgaatttgatgtgaaggctggaattgaatttacaaaagagcttcttcgaaagagtttaaccccaattcaaatgcctagcgataacctaccagttgttgatcataattccctatttcttggatgtatgccatttagagctacgaatgttttcaatatagatgcaggtgcctttcaatttgcagattatatggctaagtattttaatggaaatggtattttaacatcaccacaacctacagacgaagagatggaagcgttaatacaaccaatgaaagaagcaagtactgtagtcatcgcaacgtataatgcacatctatataaagaacaactaaaactcgttgaacttgcagcaaaatccaatacaaacgttattgtttttgctcttagaaatccatatgatttaaaagacttaccagcaaatgtgtatggaattgctgtctatgagtataccttaaagagtgtagaggcattggcagaatatatgaaacagccatatgagttgagtggaaaattacctgtgaagatg

SEQ ID NO: 153 - DNA, 1560 bp, Clostridium phytofermentans
atgctacaaaaaatgaacggaaaggttaaaaagattcttggaattagtatcgcatttcttatgttgatcatggtaattccaacatcaatcgcaaaagcagcaaccaataagacctatgattttaattcgatgacttatcaatccacatggggagttacatattctatcagtaatggatcaggaacatttaatttcactggtcaataccgtgaaattaagttcaatcttccggaaacgctagatatgtctcaatgtactagtgtaacattcaatgcttccagtccaaatggacagattgcatttaagctttacgatacttctggaaatcaggtggctgtagtgtataactttaattccaatacctcagactgtaccttcgcaccaaatagtacggcaaaggtaaacagtattggaataatggcgcaagggacaaataactactcagcagttgtgaatcgagttacatttacaatgacaggagggtcttctggcactggttcttcaactttattaaacacttatggaaatatattaaaaaactctggaactgctgttaatttaagtcagctgcaaaattcaaatacactaagtgtgattaagacgcaatataatagtatcacattagagaatgaaatgaagccagatgcagttcttggaagttcatcaacattaatgactgttgctcaagcaaaatcgaatggttattatattccttctagctacacggaaagtacagttccaactcttaaatttagtaccatcgatgcagttctacagatttgctacaataacgggctaaagcttagaggacatacattagtatggcattcccaaacaccggattggttctttagaacaggttatagttctagtggatcgtatgttagccaagctgttatggatgcaagaatggaaatgtttattaggtcttatatgagtcatatttataatggaagctatggaagtgtagtatatgcttgggatgttgtaaatgagtatttgcatgcttctacctctggatggtctcaagtttatggatccaaccttggtaccacaccatcttatgtaaagaaagctttccagtatgcgtatgattgtcttagcagttttggattaacgaattcagtaaaattgttttataatgattacaacacatatgaggttacagatcagatcctatcattagtaaattttattaactctggtacgaaactttgcgctggtgttggaatgcagtctcacttaaatacctcctatccttctgtatcggcatataaaacagctatgcagaagttcttgaatgcaggatatgaagtacaggttactgaacttgatgttacgaatacatcagcttccacacaagctacttatgtatatgatttgatgactgctattctttctctaaagaaagcaggtgggaatatcactggtattacatggtggggactatatgatagcgtatcttggcgtgcctcccaaaatcctttgttattcagtaatttaactactccaaaagaatcttataataaagcgttacaagcatttacagatgcaggatat

SEQ ID NO: 154 - DNA, 2268 bp, Clostridium phytofermentans
atgtttttcaagaaactagttgcactcgcaatggctgttgccattgtcattccaatgaacgttaataacatacaaaaggttgaggcggaatctacaaatgaagcagtagtatatggtaatctaatttatcacgactttgaagcaagcaccaatgggtggggaccaagaggtgacaatgcagaggttgtggcacaaagtacagaagaggcatattcagggttacatagtttaaaaattagcaaacgcacgcaaacatggcatggtgctacctgcgatttgacaaaggaacttacgattggagaaacttatgtatttggaatttatttaaaatataaaggtagctcttattccaatacacaaaagtttagcttacaatttcagtacaatgatggtgtgaatgatcagtacaaaacaattaagactttagaagtaaccaaagataaatggacattaattcaaggtgagtatacagttccagcagatgccgctaatgcaaaggtctatgtcgaaacagaatataagagttcaccatcaagtcaagatctcttagacttttacattgatgatttcactgcaacgccagcaactttaccacagattcaaaaagatattcctagtttaaaggatgtattttcaagttacttctttgttggtggagcggcaactgcaggtgagattgcaccagctccggcaaaagatttagtagcgaaacattacaataggttaactcctggtaatgagttaaaaccagactctgtattagattactctgcaaccatagcctatatggatgcaaatggtggtaatcaagtgaatcctcaggtgaatcttagagctgcgaaaactttactggaatatgcaagagacaataatataccagtgcgtggacataccttagtatggcatagccagacaccagattggttctttaaggtaaactattctcaggattcaaatgcagcgtgggtttccaaggaagtgatgctccaaagactagaaaactacatcaaaaatgtgatgcagctgatctcatcaacctatcctacagtaaagttctatgcttgggatgtggtgaatgaagcagtagatccaaatacttctacaggtatgagaaatcctggatcgaataacgtaacatctggtaattctccatggatgcaaaccataggtgaggaatatattcaaagagcttttgaatacgcaagaaaatatgctccaactggttgtaaactgttttataatgattataacgagtatgaggatagaaagagtacctttatctttaatatcctgaaaggattaaaagataagggcttagtggatggtatgggaatgcagtctcattgggttatggattatccaagtattagtatgtttgagacagctgttcgtaaatataatactttaggattagaattacaactaacggagttagatataaagcagccagacaatagtacatctgctttagctgctcaggcagacagatataaacttttgataaataaggtcattagtttgaaaaaagagggcatgaacattacaggagttatcttctggggtgtaacggataagactagttggttaggtggatatccattattatttgatggaaattatcaagcaaagtcagcatactattctatcattgatgggattaccccaacagtaacgccatcaataactccaactgtaacaccaaaaccaacgataacacctacagtaacaccaactgtaacgccaaaaccaacgataacacctacagtaacaccaactgtaacaccaaagccaacaataactcctaccataacaccaacagtaacgccaaaaccaacaatagctccgacaccaactcctactacagtaccagtggagggagcaaaaccggtggtagtagtaactacgaaaaacaatgggaacacgataagccagcaatacacaataaatgcacttggtggaacgattgatttgtcaaaggtatctattgagtttactgccgatggaatcatcaatcaagagcataatgtttgggtagataacgctgcgttgcaattaacagttgaaccatattacacaccgttaaatggttatgtttctgggcagttgacgaatcaaaaacttgtggttagcatcagtaagagtacgatgctgtcagaaggaacaggaaagcttgttcttgatttacgatttgctaagaaggattggacggattttggtacgatatccaatgaagtgttaaaggtttactataatggagtcaaagttcaa

SEQ ID NO: 155 - DNA, 636 bp, Clostridium phytofermentans
atgtttaaattaaataagaaagtttttgcattagtttctgtaattgcattaggtttttctagcttatttacatcaactgctcatgcagcaactgattactggcagaattggactgatggtggtggaacagtgaacgctaccaatggttctggtggtaactacagtgttaactggacgaattgtggtaattttgttgtaggtaaaggttggggtactggaaatgcatcaagagttgtaaattacaatgctggtgtattttcaccatctggtaatggttatttaactttctatggttggacgagaaattcactcattgaatattatgttgttgatagttggggtacttatagaccaactggaactttaaagggtacagtttctagcgatggtggaacatatgatatttatacaagtacgagaactaatgcaccttccatcgatggtactcagactttccaacaatactggagtgttagacagtctaagagagctaccggaagtaacgtagcaattacttttagtaaccatgttaatgcttggaagagtaaaggaatgaacttaggaagcagctgggcttatcaagcattatgcgtagaaggatatcaaagcagtggtagtgctaatgtaacggtttgg

SEQ ID NO: 156 - DNA, 2418 bp, Clostridium phytofermentans
atgggtaaaaaagtaatagctttattaacatgtgttatgctttcgcttacgctgattccgggtatcggcataaagagcactgcacaagccgctgaaaccaacatctataaagtagattggagcaaatttaatgagggtgacaaaatcagcggtcccatggagggtttaggtagatcaggcggagcagatatcacggttacgggctcctctaccaaatcattttacatatctaatcgtaaagataactgggatgcacttgatattcagaacgatcttttgaagttagatcgagatgcaacctatgaaatcacagttaccggtcatgttgacagcaatgtagatactaagaatgctagtgtcaagcttggcggtgtaacaaggaaaacgggcgaggatgatggatacccagagttcaaaaaagagaaactacaatcgggcaagagttttgtactaacctatgaacttaaactttctgatcaaattccggacgcttcaagaaatctgtgggtgctccgtgttcagaccgacgaaccaagcggaagtagggccggagatcttgtaccgttctatgtggatgatatcgtgattattcaaacaaaggcatccactgctcctgtagctgtgactggtgaccttatgtcactttacgaacttaatgcggacaaaactctcaaggttggagaatcattatcaagtccagctctgaaagtttctggtaatgctaagatagttgttgtagaaggcaccgatggtaccgtgtcattacaactgaaagaccgtgttaataattatgacggtgtagacatccttcgtgatgcactgaaaataaacgataaatttatgtctggtacatacacgattgaggtaaaaggccatgtagaggatggttctgatttaagtaaatcccagtttgttatgggtatgaccgaatctccatggggcgaactcacttcaagagtgacgccaagtagtgacggtagctttgtaataacttataccaaagcatacaccggaagtgaattgacaggcctaggttatagctaccgagttcagacacctccaagcgttctcacatcgttttatatcgataacattaccgttacggttcagggagctgaagaagaagatgagtcaactgtggttatacctgaatgggatttaacccttgattccattaaagatgcatacgctgattacttcatgataggtaatattatggaaccaggtcagatacaggatacagaaaccaccgaaatgtttaagcatcattataatgttgttaccgcagaaaatgccatgaaaccagggaatatttccaaggtaaaaggcgaatacaattttgacaatgctgataagcttgttacgtgggctaaagaaaatggtttaaaagtccacggtcatactttagtttggcactctcagtcagctccatggttgactacaaatgcggatggaacacctctaacacgtgcagaagcaagagctaatatggaagattatattaagaacgttgcaggacattacgcagggaaggtgatttcatgggatgtattaaatgaagcatttttgccaggtgtatccgaaatccctgctggctggagggatgtattacgcaaatttgaagataacggaaatggttctccttggtatcaagcctatgaaaacggtgctgataagagcaagggcgaggatggctctgattatatctatgacgctttcgtgtttacacgtcttgccgctcctgatgcagtgctgtattataacgacttcaatgagacagaggcaggtaagtgtgaagcgatcgccttgatggtggaagaattaaacacaaagtggaagaccgataaacggaacactgagcctgacagattgctcatcgaaggaatcggaatgcaggcacattattggaccggagatttaaaggtttccactgtagaagctagcatcaagcgtttcataaaaacaggtgctaagatcagtgtatctgagctggatgttcctcatggcgattacatgacctacaagcaacgtactgactctcctacaaaggaagaagagaaacttcaggcggatttatacaagcagttgtttgaagtatacaaaaaatatgcggacaacatcgaacgtgtcaccttctggggtaaaacagatcctcaaagctggcgtttccaaggttatccattactgtttgataaaaattttgctccaaaggacgcattctttgctgtaattgatgtagcaaaggaaaaggtagcagaggaaaaggctgttgaaaccatacctggtaaagatatcccgaaaacaggggaagacagcagtaagcaaatgattttgactgcagtagctattctgattatattggtattcgtaccagttacgatcttaacaaaacgaagagagaagaatataaagaatata

SEQ ID NO: 157 - DNA, 1143 bp, Clostridium phytofermentans
atgaatggtgcaataaaaagtgggtattaccggaatgtgtttaccgaattaggctataaagaagaggacgtaactaagaaagttgaggacagctttcagaccttgttctatggtctaccagaagaacgcatatattatcctgtgggtgaagatttaggatatatcgtggataccggaaatcatgatgttcgaacagaaggaatgtcttatggaatgatgatgtgtttgcaattagataaaaaagaggaatttgatcgcttatggaaatgggctaagacatatatgtttatggattctggtgttaacaaaggctattttgcttggtcatgtaaaacagatggtacgaaaaattcctatggaccagcaccggatggtgaggagtattttgctttagcattattctttgcttccaaccgctggggtgatggaaatggaattttcgaatatagtaaacaagcgagagaacttcttcatgaatgtatccataaaggagaagaggatggaatcggagaacctatgtgggagccatcgaactacctgataaaattcatacctaattgcaattttacagatccatcgtatcatttaccacacttttacgggttatttgcactttgggcatatgaagaagatagagaattctttaaaaaggcagcggaagcgagtcgttcgtatctaaaacttgcatgtcatgaaaagactgggctttgcgcagaatacacagagtacgatggaactgctcatagtggagatcaagaaatatttggacgccatgattggtattacagcgatgcttatcgaaccattgcaaacattggtcttgattatctctggtttgcagctgatgaatggcaagtaacatgcgctaatcatttacagcaattcttttgtgagacagtaaaagagcatgcaagtggtatttatcaagtagatggaacgataatcaagggcgaggctttacaccctgttgcaataatcgctaccaatgcgcaagcatctttagcagcaaatggtccctttgcgaaagaatgtgtcgacaagttttatcatacagaattaaggactggcgatagaagatattacgacaattgcttgtatatgtttgcactcttagctttaagtggaaagtatcgtatgtggatg

SEQ ID NO: 158 - DNA, 1536 bp, Clostridium phytofermentans
atgagacaagaatattgtaatccagtacaacgaggatttttcccagatccgtctgttattcgcgttggagatgattattacatggtgaattcctcctttcaatacttcccggcaattcctatttcacattccaaggatatggttcactggcatattataggacatgcgataacgaatcctgaatatcttccattagaggatatcaaagattcacacggtatttgggcaccagatatttcgtaccatgatggaaccttttacatttatgcgacacttcgtttaaacggtagcggtaccagaggaaataatgttcttcgaagacagcttttggttacttcaaagacaccggaaggtccttactctgcacctacttggctcgaagtagatgcgattgatccatcccattttgtcgatgacgatggaaagcactatatggtaattgcgaaagcagctaccgttattccattaagtgatgatggaaaacgtgtgattggtgaaccatttgcagcatggactggaacaggagagtgttgtccagagggaccacacattttaaaaaaggatgggtactactatgctatcgttgcagaaggtggaactgggtatgggcatggaataaatgtggcacgttctaaaaacttatatggtccttatgaggagtgcccttataatccagtactgcgtcagtttaaggaggattctcctattcagcgtaccggtcatgggaaattggttcagacacaaaatggtgactggtggatgtattatttacttggtagaccaaaccaagggagatatacgaccgttggtagagaatctggccttgatccagttacctggacagaggatggctggtttatcgtaaatgaagggaaaggtccaagtgaaagacagatagctccagaccttaaaccacatgtctttgagagaaatttaaaggacgattttgaggaagagaagcttaatttagattgggaatttgttcgaaatcctgactatggtagctgttcgtcaacagagagacctggatactttcgcatctggacaagagatggtagattagatgagattcgtgctaagaatactttagttcgtagagagcaagaactatcttatgaagcagaaacaaaagtagaattctacccaaccaaagatggtgagcaggcaggtttaacttgttattatagtacggccacttatgcaagattttctctttgctatgaaggaggaagaaaacttcagcttgtaataaatcgaaatcatggagaagaattgatggcggaagttctagacatcaaggaaagagcagtttatctaaaagtaatagtggagaagttaacccgtagtttttattatagctacgatggtaaggagtggactttggctggagtattagaaaattgtatttacctttgcgatgagggtgttccagatgatccaaagcgccataccggcactttagtaggcatttatgccaacaacggaggttgcggttctagaataccagcagactttgattatttttattatcaggaa

SEQ ID NO: 159 - DNA, 1908 bp, Clostridium phytofermentans
atgaaattacgcgaggcaatattaaacagagatttagatgttgtgaaggatctattagtaaaggatccaaattcaattgaggataaaactggaggagtatggttaccatttttggcagcatctctaggagatttagaaattgtacggtatattgtagaatattccagagcaagttttaatgaaacagatgaattaaacagaaacgttcttcattatggtgttgaatcaggtaacatttccgttgttcgttacctagtagaaagagttggaatgtcaccggtttctggagatatcaacctagtaacaccatatgaaatagcatacgaaaataaaaataaagaaattcttacttactttgaagaagtttgtggagcaccatatgaacagatgtatcataacccaattcgtaccggtatgcatccagatccatcaatcatttgtgtgggagatgacttttatatggttaactcctcctttatattcttcccttgtattccaatctctcattccaaggacttaattcattggaaagtcattggacatgcaattacaaacccagagtgggcgtacttagatgaactagaaggtggccgtggatattgggcaccagacatttcttattatgaaggaaaatattatattactgcaacctatcgtttaaatgacactggaactgtctatagaaaacaaatggttgtttcttcggataaaccagaaggtccatattgtgaaccagtatttcttgatgaggatggtattgatccatctatctttacggatgacgatggaagacgctatatgttattaaatcgtggagcaagaatatttgagattagtaaagatggaaaaaaacagctttccgaagctacccttttatattatgggcatcaaaagagagcaccggaaggatcgcatttacttaaaaaggacggttggtattaccttttccaagcagaaggtgggaccggtctaggtcatcgtatctctgttgccagatccaaagaactatttggtgtatacaccccatgcccttacaatccgattatgagacagcaggatgaaaagggagcaatcaaacgttgtggtcacggaaaacctgtgaaaactccaaatggtgagtggtatatggtttacttatgtggcagacagttagagggtgaatatagcttacttggacgtgaaacagcactcgatccaattacttggacagcagatggttggccacttgtaaataatctggaaggacctagtgtcctacaaaaactaccaaacttaactccatatattcctgaaccggagtcggatgattttaagaatggtatattaagcagtttatgggtatctcaacgcgtaccagaggagaatgcgtatacatttggcaatggatacttaaagatacagggaagtaaaaaagatttagatacgacagagtcaagaaatattttattacgcagacaacaagattttcactttacgtttgaggtaacagtaggtgatataaaccttaacattggacaggattatggtttaacctgttattatgatgaaaatacgtatcttaaatacggtctcttcgaaacaaaagaaggtttattcttacaggtagtggaacacattgatgaggagacaaagataagcctatcaacaaaggttacaaaaggagagtacagtcttcgcattgtgacagaagggcttaagagaagcttttattatcagagcatagttgatcaggaggaaactaattggcattcccttggtcagcttgatcgagtttattatctatgtgatgaaggtatcaatcgaggaaaacgctttaccggtgctatggtaggtatgtatgctcacgctggtgagaactcctccttaactggtgaatttaaagacattgtatatcaaggtatggaccga

SEQ ID NO: 160 - DNA, 1497 bp, Clostridium phytofermentans
atgaaagcaaaacttactttatcaaagattagtaagataggaaccatagacaaaagaatttatggctcctttattgagcatctaggaagagcagtatacggtggtatttatgaaccaggtcatgaaacttcagatgacatgggatttcgtcaggatgtaatggaattgattaaagaattaaatattccaatcgttcgttatccaggtggtaattttgtatcaggctatcgttgggaagatggtattggagataaggcgaagagaccaaggcgtcttgaccttgcttggaagagcattgagacaaatgaggttggtgtagatgagtttcaggaatgggcgaaacgtgccaatagtgatgttatgatggctgttaatctaggtaccagaggaccacaagaagcgcaggatttaattgagtattgtaattttcaaggaggaacttattacagtgacttaagaagaaagaacggatttgagaagccatttgatattaaagtttggtgcttaggtaatgagatggatggaccatggcaaacctgtgctaagacagcagaagaatacgggagaattgcttgtgaaacagcaaaagtcatgaaatgggttgatccaagtatcgagttagtcgcttgtggtagttctggtttaacaatgcctacctttggagattgggaacgtacggtattagaacatacctatgattatgttgattatatttccctgcaccagtactataataattatgaaaatgatccagatgttttcttagctagatcattagagatggaaacctttattgaatcggtagtagcaatttgtgattctgtgaaagcgaaaaagcattctaaaaagaccatcaatctttcctttgatgagtggaatgtatggttccatagtcatggtcaagataagaggatagagccttggggcaaagctcctagtttattagaggatgtctacacttttgaagatgctttgttagtgggatgtttgctaatcgcactggttaaacattgtgaccgcgtaaagatggcgtgtcttgctcaattagtaaatgttattgctcctattatgacagagaatggtggagctgcttgggctcaaacaattttctatccatttatgcacgtatcaaattatggtaggggtaccgccttaaaaccaatcttagagtgcgagacttatgagaataaaatcagtgataaagtaccttatgtagaaacagttgcagtacataatgaagaaaagaatgaggttgtagtgtttgctgtaaatcgctccgcagatcaaaccattgatttttcaattgatttaacagagtttcagaatgcaaaattggtggagcatactgagatgattcatgctgatttaaaagctacgaatactgcaagcaatcctaagaatgtagttcctagtgcaactggagttacaaaaatagaggaaaataccgcaatagctacgttaaagccttattcttggaatgtaattcgtttttcattg

SEQ ID NO: 161 - DNA, 2184 bp, Clostridium phytofermentans
atgataagaggtaaaaagagagtaattgcaatggcggtatctttatgggttgtcgtagccatgctatttactagtgtacctggacctttggggtcaataataggtacaaaaagcagtacaaaggtacaagctgctgagaaattttcaacgaaattagaagcagagaatggaaagatgactggtactgtaacggtagccactacaaggccagggtatagtggaactggatatgtcaccggttttactcaaaacagcagtaattcctggtcaacttctgtagtgattccgacaactggtcactacacatttacaatccgaagtgctgcagatagttataaagaaaattatctttatattaatggtacacaagctggaattatttatagtacaggtgatggtaaatggggagatactgtcatcgaaagcgtatacttagaggctggaactatcactttatccgtaaaggaaaattggggttggtttgacctagattacattgcaattgaggcgggaagtggtgttgataactctgtttatcagaaggcaacgtctactctagtaaacccgaatgcaaatgaaaaaacaaagaatattatggcatatctaaagagtatctacgggaaaaagactttagcaggtcagtcctgtacgttaaacgcaagcactgaaattgaagcactttataaagcaactggaaaatatcctgcaattcgtatgcttgatttaatcttttgttctccagcaagcgactggcattccacaggagaagttgatttggcacttgactgggataaaaaaggaggactaacgacatttcagtggcattggcatgctccaaaaggtggtgcatctttttataccgataaaacatcatttgatttatccaaagcagtaacatctcaaaatatcagtagattgccattggcagatgtaaaagcattgtatgattcgggtaagatttctgaagaatgttatctgatggttcgcgatatcgatgcaatctctggctatctaaagcaattacaagatgccggtgtcacagttctttggagaccgcttcatgaagcgagtggcggttggttctggtggggcgctgccggaaaagatccatacctttggttatatcgcctcatgtttgatcgccagacgaattatcataaattaaacaacctaatatgggtatggaatggacaggatgcagcttggtatccaggtgatgcctattgtgatatcgtaggaactgatatttatgctgataatcgcaattacagtgcacaaacagctcaatttaataaaacagtaaattatgcgaatggaaataaaatggcagctcttagtgaaaatggtgtaatgattgacccagctttgatgacgagagacaataccttctggttatggtttgcagtatggtatggagatttccttatcgattattcgggcaacctaaatggaacatatactgaggcttctatggtgaaaaaggtttataacagtaatgaggtgataaccttggataaactacctaattttaatggaacaactccaacggtaacaccaacaccaacaccaacagttaagcctacagtaacgccaacagtaacaccgacgccaacagttaagccaacggtaacgccaacagcaacaccgacagcaacaccgacaccaacagttaagccaacagtaacacctacaccaacggttacaccatcagtaacaccaattccaggtagttttactctttctttaaccaatacaggtaataacaatctatcaacaaacacaataaatgctgattttaagattaaacatgagaaaggaagcgatatagatttatctaagctagtgattcgttattattatacgaaggagggaactgcgaaggagaacttctattgtgatactgctgcaatgcaattaaataaagatccatggtacattccatatacatcggtagttaatggaacctttaactcaatggcggtaccaaaaacaaaagcagattcgtatcttgatgtatcgtttaacacaactgataaattatccgcggattctacctttatagtgaatatcagatttacgaagagtgattggagcttgtataaccaagaaaatgattattcttatggagatagtacaaaagttgttgtgtactataatggtaagttggtactaggtgtggagcca

SEQ ID NO: 162 - DNA, 2571 bp, Clostridium phytofermentans
atgaaaggtctagttaaaaaagtaagtacgtttatcatcgcactatcactactgtttagttttattacagtaccggtcagtgcaggcactgcgttgttcgttatcgaaagcgaaaatacgcgactatcatctgagttacaagttgtgacggcaatatatggacaaccaaagcctggatactcgggagcaggatttgtttggatgcagaactcaggtacattaactttcgatgtcactgttccagagacaggtatgtatacgatatctactcgttatatgcaagagttaagtacggatggcagactccaatacttaagcgtaaatggtatcaataaaggttcctttatgttgccatatactacagtgtggtcagattttaattttggtatttataaattgaccaaaggtagcaacacgatacaaattaaggctggttggggattcgcttattttgatacattcaccgtggattatgctaaactagatagtttaaatgtagcgccaacccttaccgatagccaggcaacatcagaaacaaaacttctaatgaaatacttaacggaggtttacggtaaacatatcatctctggccaacaagagatctatggtggtggaaataacggtaattcagaattagagtttgattggattcacaatttaacaggtaagtatccagcgattagagggtttgattttatgaactataatccattatacggttgggaagatggtacaacaaatcgtattatagattgggttaataataaaaatggtattgcaacgggatgctggcatattactgttccaaaagattttaattcctataagcttggtgattttgtggattggcaaaagacaacctataagccaacggaaacaaattttaaaactgcaaatgctgttattcctgggacaaaagaataccaatatgtaatgctgacaattgatgatttagcaaaacagctactgatattacagcaaaacaacgtacctatcattttacgcccatatcacgaggcagaaggtaatggcggagcaaatggtgaaggtgcgtggttctggtgggcttccgcaggtgcaaaagtttataaacaattatgggaaatgttatatactaggctgacacaaacatatggattacataatataatttggacgtataacagctatgtttacagtacctctcctgcttggtatcctggtgataatttggtagatatcgtcgggtatgataagtacaatacagtctataaccgctatgacggattatccggtgttccgaacgaagatgctattacgactatcttctatcaactcgttgatttaaccaatggaaagaagatggttgccatgacagaaaatgacacagtaccaagtcttcaaaatctaaccgaggaaaaatcgggttggttatatttctgcccatggtatggtgagtatctcatgagttctgcaaataattatacaaaaacattaaaagagctttatcaaagcaattatgttattacgttggatgagttacctaacctaaaagttgatgatcaaacaccaagctcgacaatcacgccgacttctataacatttgataaatatacaccaaatcaaagcgataaaacaatttcgattgtgtttaatggaaatactttaaattcacttaaactaggtaccaccacattaaaaataaatgttgattacacattaagcggaaataatcttatattaaagaaaactttcctctcacaattaccaacgggtgaaagttctatcgtctttgactttgacaaagggaaagatcctgttttaaaagttaatgtcgtagattcaacgccaagtgctacaattactccggttaatgcaacctttgataaagcagttgataagcagcaaaatatcaacgtaacggtcaacttaaatgggctttcgcttgtaagtgttctaaataatagtaataaacttttactaaataaagattatacggtatcgggcaatacaattgttttacaaaaatcctatctatctacactatcacttggggaaagcaaattaacattccaatttagtgctggaaacaaccctgtattaacattgaatgtcatagataccactgctcccgtaattacaggaaatttagtaattcaagcctttaacggaaatacgagcgcatccaccaatggaatatcacctaaatttaagctgattaacactggaaacacagatatcaatctaagtgatataaaacttcgttattactatacgattgatggagaaatatcacagaacttctggtgtgattgggcaagtgttggtagtgaaaacgtaaaaggtgaatttgttaagcttgctaaaccagttagcggagctgattattacttggagatttcctttactgcttctgctggaacgttaaaagctgggcaaaatgcagaaattcaagcaagatttgctaagtcgaattggtcaaattacaaccaagcagatgattactcatttaatgcatccagtagccaatacgttaattctgacaaagttacgggatatttaagcaataagcttgtatggggaatcgagcca

SEQ ID NO: 163 - DNA, 1596 bp, Clostridium phytofermentans
atgagaaagcaaggcttctatctaatgtgtttgctgcttggtttatctgtaaacggatgtacatcacctggaacatcaggagagagtagtaatccaaaagatgttgttgtagacacagaagtcgtaaatacagaaacagtaaatacagatgctgcatgcacagataccccaagtacagttttaccctttactacactatcacctactatgataccgattgaacttgaagcggaagatgctgtacttagtggaaatgtaaagatagaaagtagcaaaagtggattttcaggaacaggatacattagcggattcgaagatgacagtgattattgtgaatttaagcttacgatagaggaagatggtttttatgatctaaacttcattagtgcagcgcttggtggatacaaagaaaattatgttttagtagatgatgaaaatgttggtgtagcagtaaccgatcaaagcaaattctcagattcgaaattagaaagaatatttcttacaaatggaactcataacattaagctatcaaaattctgggggtgggttgtcgtggataaattaatagtaacatcctccatagaactagatacgagtatctatgaagttcctgcaacattagtaaatcaaaacgctagtgatcgtacaaagagattgatgagttatttaaccgatatctacggtaaaaagtttttatctggtcaatattgtgagaaaggaatgtatggaacagaaatttctgcaatatggaaaacaacagaagggaaatttccagcagttctaggtcttgatcttatagattatacttcatcaagagtagaaaaaggtagcagttcgaaagctatccaatatgccatggaatttgatgaaaaaggcggtattgttacattctgctggcactggaatgcaccaacgaaatatctaactggaacatggtatcgtggtttttatacggaagaaacaaacatagatttggttaagattatgaacggtcaggatgatgaaggatatcaattgttgatgaatgatattgatgccattgcaaaagaactacttaaactaaaagaagcagatgtgcctattttatggagaccgttacatgaagcaagcggtgggtggttttggtggggagccaaaggtgcagaagcctataagaaattgtacatattattatatgaaaaactaacaaacgaatacgggctaaataacttaatctggctatggaatgggcaggataaggaatggtatccgggagatgaatatgttgatattatcggtgaggatatttatcctggtgaaaaagtttatacctctcagattaataaatatttaaaggccatgaattatacacaagcaaaaaagatggtcgtattatctgaaaatggttgtctgtttgacccggatttagcaattcgtgatggtgcaatgtggggattttttgcaacatggggtggcgaatttgttacaaaatccgctttgattaactggctatcagaacagtatacagaggagtatatggttaagaaggtctatgcccatgatagtgttataacactagataaactaccagacttaaagaattacccaatttatgaa

SEQ ID NO: 164 - DNA, 2454 bp, Clostridium phytofermentans
atgatttcctttgaaaatgatgtcttttggctagatacggatactacctcttatgtgtttcgtattactccatatggacaccctgaacatatttattatggacgtaaactggcacatcagccggtggatgctcttgcactgaaacgaacagctactatcggttcatccgtactatatgagccaaacgatccgctgtattgtcttgaccatcttagcttagaatggtccggtatcgggcggggcgactaccgtttcagcccagctgaaatcaaaatgccagacgggagttttaccaatgattttatttacgattcttatcgtatcatggatggctgcactccgatggaagaattaccttttgcaaaatctgaagatgcgcagacacttgaaattgttctggtagataacgttggacatgcaactttaagtctttattacactgtattttcacagaccgatgtaattacacgccgttgtaccttaagaaatcagggaccgaattttcaaaataaatctcattccttacagcaaaacgatgagcaaatatcgacactccaagattctcaaagccacttggaagtaaagaattcctgtgaaaatgagcaacataaagaaagtcccatcgttatccgccgtcttatgagtatgatggtagacctcccaaatcaaagctatcaactaattacctttgacggagattggattaaagaggcacatcggcatgatcgtctgttaatgccaggaatgtatgtaaatggttctgttaccggaacaagctccaatcgtcataacccaggatttctcctcgccaatgaacgtgccgatgaaactcatggtaatgtttatggttttaatctgatttacagcggtaatcattttggaggtgcggaactatctccccatggtttggtacgtgttacacttggtattaacccccactgttttgaatgggtattaaatcctggagaatctttttctacccctcaagcagtgatgactttctctgatcagggattccatggtatgagtcgacattttcatgattttattaaccagcatatcgtaccagaatattggcaaaacagagagcgcccgattctctacaacagttgggaagcttatttttttaaatttaaccaacgaaaactattacataccgcaaagcacgcccgttctcttggcatggagctttttgtattggatgacggctggtttggcaagcgtaacaatgacaatgctggacttggtgattatgaagtaaataaaaagaaattccctcatggaatatccgcattttcccgtaaaatccgtaaaatgggtatggaatttggcttatggtttgagccagagatggtaaatgaggactcagacctataccgaaaacatccggattgggcggtacatacgccacgtaggaatcctacctatggcaggaatcagttggttcttgatttgtgcaatccgaaagttagggattatatcgtagaatccgtggggacggtattagatgatgcggaagtatcttatgttaaatgggatatgaaccgacacatcagcgacgcttattctaggttgctttcagaacagggggaattctttcaccgatacatcttaggattatatgagatactgaaacgaatctttgccccgcgcccccacatcttgttggaaacctgctccagcggtggcaaccgttttgaccttgggatgctttgctttggtccgcaaatctgggtttccgactgtactgatccagtagaaaggctttccattcaaggcggattatcttttctctaccctccctctacttttggcgctcacgtgtccgaagcaccacaccagcagaccttgcggcagacgccccttgctacccgctttcataccgcctgctttggatgcttgggctatgagcttgagttaaaatacctttcaaaaatagagcgttcagaaattcgggagcaaatagcattttataaattgcaccgccctaccctacagtttgggaaattccgccgcttagagcctataaaatcaaacatcatccaatggcaatgtaccgaaaaggatgaaagtaaagcaatcgcagggtattttcaaaccttggcaaatgccaatccagaacatgatattcttatcgtgtcagatttaaatgaaaaatataactatcaggttactacgaaacgtcagcgtctgtttatcaaacgatttggaggactgattaaacacgttcttcctgtatcactaaatccggacggttttttattaagactggtcaaccgtttctatgctctcctcgactgtacagaagaatatattggagatggccgcctgcttggaagtgggattcttttaaacaaccagtttatgggaagttattataattttgaaactaggttactgggagatttcggctctaatctctacctaattaaacaaatggaaagtgaggtttcc

SEQ ID NO: 165 - DNA, 2790 bp, Clostridium cellulolyticum
atgtttagaaacatcaataaaagaattcttgcttttgccattgttgttgcaatgcttatgtctttcattccaacaatggctttcgcagcggaaccggatagctctcatctcattaccagtcaggctgaaaagccttcaactgccggtgcccttcaaattcttgataaaaacggaacaaaaacattatgtgacaaagacgggaaccctatacagcttcgtggtatgagtacccacggccttcagtggtatcctgaaataattaacgataatgcctttgcagcactctccaatgactggggaagcaatgtaatccgtattgcaatgtacgttgctgaaggcggatattcaaaagaccctgaaacaattaagaaaagagtaattgacggaattgatttagccattgcaaatgacatgtacgctatgctggattggcatgtgcttacaccaggcgacccaaatgcagacatatataaaggtgcaatggatttcttcaaggaaatatcccaaaaataccctaataatccgcatataatatatgaactggctaatgagcccagccccaacgatccgggtgttacaaacgatgcggcaggttgggcaaaagtaaagagttacgcagaacccataataaaaatgctccgtgacagcggtaataagaatctagtaattgttggaagtccaaactggagccagcgtcctgatttggccgcagacaacccaattaatgataacaatacgatttatactgttcatttctatagcggtacacataaaccctcagcggacagttcagacagaggaaatgtaatgagtaacgcaagatacgctcttgagcatggtgtagctgtttttgcatcagaatggggaaccagtgaagcaagcggaaacaacggaccttacttgaaagaagcagatgaatggcttgaattcctcaatgcaaacaatatcagctggtgtaactggtctctgacaaataagaatgaaacatcaggatcgtttattcctttcatatccggcaaatcagatgccacaagcctggatcccggagatgatcaggtttggtcaccaaaagaactgagtgtatcgggtgaatatgcccgtgccagaataaaaggtataaaatacgaacctattgatcgtgctgaaaaagaagagtttacaacaaatgtatgggatttcaatgatggaacgactcaaggtttcggcataaacggtgacagtccggttaaagctgacagtatcactattgcaaatgaaaaaaatactcttaaaatcaccggcttaaataccagtaaggatcttaccgaaggaaactactgggcaaacgttcgtctttcagctgatggtacaagcaataaacctaacattctcggtgcagaaaaacttacaatggacattattacagctgctcctgccacagtgtcaatagcagccataccacagaattcaacccatggttgggcgaatcctacacgtgctattgcggtgaagccagctgattttgtaaaacaggaagatggtacatataaagccgtattaacaataacacctgctgattcaccgaattttgattctatagcaaaagacagcaaagatagtacaatgactaatattattttgtttgttggtgcggatacaaatgttatttcacttgacaatataactgtatcaggaaaccgtactaccgtagaagcacctgttgagcatgctccgataggaaaagcaacacttccttcaatctttgaagactcaacccgtcagggatgggcctgggatgctgcttcaggagttcagagtgccttgacaataaaagatgcaaatggttcaaaagctatttcctgggaagttaaataccctgaagtcaagcccgtagacggatgggcttcagcaccgcgtatcatgcttagtaatataaacgcaacacgtgggaataacaagtatcttgcttttgatttctatcttaaaccgacacaggcaagcaaaggctctctctcaataaatctggcttttgctccaccaacccttggttactgggcacaggcatcggttaatttcgatatacctttaacaaaactgagtaaaatgaaaaaaaccaaggatgggttgtaccacttccaggtaaaatatgatttggataaagtaaatgatggaaaagtacttgctgctgatactgtcctccgtgatatcaccatcgttgttgcggacggtaacagcgactttgccggtaccatgtatgtggataatgtcaggttcgaaaatgacagcaaaagtgaacttaataatgccattgcgatgttggtatcaaaaggtataatcaagagctctgatgttaaaaaaattaacttgaataagagcatttcaagaggcgagtttttgaattggctagttaagactttagatttgaatgcaaaatatagtgttaatttcagtgatgttcataagaaagacagctactataatccagtgggtattgccaaagcacttggtattaccaacggagtcggacataataaattcaatcctaataaagcaataagcagagaggatatgttagtattaacctttaaagctctgaaattagtaaataaaaatttggttaaaggtaatgctgacgatctgaaacaatttactgatgcttcaaaggtttcaaggaatagtgttgaaagtatatccactatcgtaaagaacggattttattcaggtgatgcaaagaaactgaatctaaaagcgtctgtttcaaaagctgagactgcgttaatgctttataaaatatacaccagtttacataaa

SEQ ID NO: 166 - DNA, 2220 bp, Clostridium cellulolyticum
atggtttctttcacttctttgttggccggtgttgctgctatctctggtgttttggctgctccagctgctgaagttgaaccagttgccgtcgaaaagcgtgaagctgaagctgaagctgcttcttccccagctaacaaggtttaccaagacagattcgaatctatgtactctaaaatcaaggacccagccaacggttacttctccgaacaaggtattccataccattctatcgaaaccttgatggttgaagctccagactacggtcacgtcactacttctgaagctatgtcctactacatgtggttggaagctatgcacggtagattttctggtgacttcactggtttcgacaagtcttggtccgtcaccgaacaatatttgattccaaccgaaaaagatcaaccaaacacctctatgtctagatacgacgctaacaagccagccacctacgccccagaatttcaagacccatctaagtatccatccccacttgacacttctcaaccagtcggtagagatccaattaactcccaattgacttctgcttacggtacctctatgttgtacggtatgcactggatcttggatgttgataactggtacggtttcggtgctagagctgatggtacttccaagccatcctacatcaacaccttccaaagaggtgaacaagaaagcacctgggaaactattccacaaccatgttgggatgaacacaagttcggtggtcaatacggtttcttggacttgttcaccaaggataccggtactccagctaagcaattcaagtacactaacgctccagacgctgatgctcgtgctgttcaagctacctactgggctgatcaatgggctaaggaacaaggtaagtccgtctccacttctgttggtaaggctactaagatgggtgactacttgagatactcttttttcgacaagtacttcagaaagatcggtcaaccatctcaagctggtaccggttacgacgccgctcactacttgttgtcttggtactatgcctggggtggtggtattgattccacttggtcctggattattggttcttcgcacaaccacttcggttaccaaaacccattcgctgcctgggtcttgtccactgatgccaacttcaagccaaagtcttccaacggtgcttccgactgggctaagtctttggatagacaattagaattttaccaatggttgcaatctgccgaaggtgctattgctggtggtgccaccaactcctggaacggtagatacgaagctgtcccatctggtacttccaccttctacggtatgggttacgttgaaaacccagtctacgctgacccaggatctaacacctggttcggtatgcaagtctggtccatgcaacgtgtcgccgaattgtactacaaaaccggtgacgctcgtgctaagaagttgttggacaagtgggctaagtggatcaacggtgaaattaaatttaacgctgatggtaccttccaaattccatctaccatcgactgggaaggtcaaccagatacttggaacccaacccaaggttataccggtaacgccaacttgcacgttaaggtcgttaactacggtactgacttgggttgtgcttcttctttggctaacaccttgacctactacgctgccaagtctggtgacgaaacttctagacaaaacgctcaaaagttgttggacgctatgtggaacaactactctgattccaagggtatttccactgttgaacaaagaggtgactaccacagattcttggatcaagaagttttcgttccagccggttggaccggtaagatgccaaacggtgacgtcattaagtctggtgtcaagttcatcgacatcagatctaagtacaaacaagacccagaatggcaaaccatggttgccgctttgcaagccggtcaagttccaacccaaagattgcatagattctgggctcaatctgaatttgccgttgccaacggtgtctacgctatcttgttcccagaccaaggtccagaaaaattgttgggtgacgtcaatggtgacgaaactgttgatgctatcgacttagctatcttgaagaagtacttgttgaactcttccactactatcaacaccgccaacgccgacatgaactctgataacgccatcgacgccattgattacgccttgttgaagaaggccttgttgtctatccaaggtggtggttccggtggtggttcc

SEQ ID NO: 167 - DNA, 1503 bp, Clostridium cellulolyticum
atgaacaaaataaagatttcagataaggttacaggaagtttcagggataattggaatttctgtgtaggtacagagcgtatggggatcgctcttcaaaaggaataccaggatactctcgagtttgttcagaaggcaataaatttcaaatatatacgaggacatggtctttttcatgatgacactgccatctacagggaatatgaaatagacggagaaatgaaacctttttataactttacatacatagacaggatttttgactcattccttgaaaagggtctcaagccttttgtagagctgggatttatgccgtcacaacttgcatcgggaggacagactgtattttattggaaagggaatgtcactcctccaaaggattatgacaagtggaaaaatctcattcaagctttgataaaacactttataagtagatatggtatagaggaggttctccagtggccttttgaggtctggaacgagccaaatttgaaggtattctggaaggatgccgatgagtccgaatactttaagctttataaggtgtcggcaacagctattaaggaaatcaataaggatttacaggtagggggccctgctatatgcggaggtgccgactactggataaaggattttttggagttctgcaaaagagaaaatgttcctgtagattttgtttcccgccatttatattctgcacatatgccaaaacttcagacacatgaattttgttatcaggatttgaaagaacctgaggaaatgcttaaagaattacagacagtcaggcaaatgattgacaattcaccatttccacacctgccatttcacataacagaatacaacacctcatacaatccattaaaccctgttcatgatacatgtctcaatgctgcgtatctggcacggattataagtgaagccggggatattgtggattcattttcatactggaccttcagtgatgtatttgaagaggcagatgttccaagagctcagtttcacggagggtttggccttgttgcccttaacaatattccaaaacctacttttcatatgttcagcttttttgaacaaatgggtaaggatatattgtacagagatgaaaatatgctggcaacaagaaaagctgacggtacagtgacaataaccgcttggaaccctgtaatggagaaaggtgaccattttaatatggatttctcactggaactgaatctgccaaaaggagaatacttcatcaatcggactattgtaaatgaaactcatggtaatccatggagaacttggatacaaatggggaggcctagattcccgggtaagaagcaggttgaaatattaagaaatgctgcacgccccatggtaatctccgaaagggtaagctgtaccgatgaaatattgcttcttgagtttacacaaagtaaaaacgaggtatcttttattgaaatcattcctgtagcagatgagactaacacttactataaacttgatgacagtttgattcccgggtat

SEQ ID NO: 168 - DNA, 1773 bp, Clostridium cellulolyticum
atgaattggaaaaatacaattataagccttactctggcaggcagttttatttttaccatgagttcatgtacttccaagcctgtaagcagtaatgttccagaagtaacaaatcaggcggttacaagtatgtctcaagatttaaaagctgaaaacgaaataagtgatgatgtacatgtaaaccagttaggttataagacactgtctaaaaagatagctgttattaaggggcaatataagaagtttcaggtggttgacagtaaaacaggtgtggcagttttaacaggagatcttactgggaatccaaaggacgaatccagcggagataccgtatgctatgcggactttagcaaaattacagtacccggtaagtactttatctcgatatcaggattaggtaaatcatatgattttttaatagatgataatgtatattcaaagcttggtgacgctatgcttaaagcactttgttaccagcggtgcggaacagcacttacacctgattttgcaggtgaatacagccatgcggaatgtcacaagacattagctaaattctataacgatgagacaagggagattgacgtaagcggaggctggcatgatgcaggagattatggaagatacgttgtacctgcaacagtaacagttgcaggtttacttctggcatacgagttttatcctcaggtatttacggatgcagtaaggattcctgaaagcggcaataaaataccggatgttcttgatgaagcaaaatacggaattgagtggcttcttaaaatgcaggatagtgaatcgggcggagtatatcacaaagttacttcaagggtattcccggaaatgacaacaatgcctgacaaggatgttgacaatcagcttgtaatgtccatatcaactaatgctactgctgattttgcagcagttacggcaatggcttcaagaatatatgttactatagatccagtattttctcaaaactgtttgcaggcctcccaaaaagcttgggaatggcttgaaaaaaacaaggatttcgtcagtttcaagaatccttccgatgtggcatcaggagagtatggcgacagttcaggaaaggatgagaaggcttgggccgctgcagaactcttcagagccacaggaaacgagaagtacaacgaatattttacagacaattatcaaattgaaggctttggacttggatggcaaaatgtaagcggatttgcggcaattgcatatatgttttcagacgtatcaggaaccgatcagaaaaaagtagatgaaatcaaaaaggcatggcttgataaagcggatatgtttgcctctactggacaaaaggatgggtatctggtagcaatgcataaaatggagtataattgggggagcaacatgaatgtcgcaacacatgccatgcatctgctcatatctgaccgtcttaaaactgatgataaatatatacacacagcagaagattgcacccattatctgttggggagaaatacacttaaccagagctatataacagggtttgggtcaaagcaggtaaagaaaccacatcatagaccgtcagcggctgatctggcattaaatcctgttccaggattaatggtaggggggccggactcggcactggaggatgatgtagcaaaaagcaaactctcagggaagtttcctgctgagtgctatattgatgatataaattccttttcaacaaatgaagttgctacctactggaattcgccggtaatttttattctaggttatttaaactcaaatagattatta

SEQ ID NO: 169 - DNA, 2712 bp, Clostridium cellulolyticum
atggtctctttcacttctttgttggctggtgttgctgctatctccggtgtgttggctgccccagccgccgaagtcgaaccagtcgccgtcgaaaagagagaagctgaagctgaagctttggttggtgctggtgacttgattagaaatcatactttcgacaacagagtcggtttaccttggcacgttgttgaatcctacccagctaaggcttccttcgaaatcacctccgacggtaagtacaagatcaccgctcaaaagattggtgaagctggtaagggtgaaagatgggacattcaattcagacacagaggtttggctctacaacaaggtcatacctacaccgtcaagttcactgttaccgcatctagagcttgtaagatctacccaaagattggtgatcaaggtgatccatacgacgaatactggaacatgaaccaacaatggaacttcttggaattgcaagctaacaccccaaagaccgttacccaaactttcactcaaactaagggtgataagaagaacgttgaatttgcttttcaccttgctccagataagactacctctgaagctcaaaacccagcctctttccaaccaattacttacacttttgacgaaatctacatccaagatccacagttcgccggttacaccgaagatccaccagaaccaactaacgttgtcagattgaatcaagttggtttctacccaaacgctgacaagattgctaccgttgctacctcctctactaccccaattaactggcaacttgtcaactccaccggcgctgccgttttgaccggtaagtctaccgttaagggtgctgatagagcttccggtgacaacgttcacatcattgatttctcttcttacactactccaggtaccgattacaagatcgttaccgacgtctctgtcactaaggctggtgacaacgaatccatgaagttcaacatcggtgacgacttgttcacccaaatgaagtacgattccatgaagtacttctaccacaacagatctgctatcccaattcaaatgccatactgtgaccaatcccaatgggctagaccagccggtcacaccaccgacattttggctccagacccaaccaaggactacaaggccaactacaccttggacgttaccggtggttggtacgacgccggtgaccacggtaagtatgttgtgaacggtggtatcgctacctggaccgtcatgaacgcttacgaacgtgctttgcacatgggtggtgacacctccgtcgctccattcaaagatggttctttgaacattccagaatccggtaacggttacccagatatcttagatgaagctagatacaacatgaagactttgttgaacatgcaagtcccagccggtaacgaattggctggtatggctcaccacaaggctcacgacgagagatggaccgctttggctgtccgtccagaccaagataccatgaagagatggttacaaccaccatctaccgctgctactttgaacttggccgctatcgccgcccagtcttctcgtttgtggaagcaattcgactctgccttcgctaccaagtgcttgactgccgctgaaactgcctgggacgctgccgtcgcccacccagaaatttacgctaccatggaacaaggtgctggtggtggtgcttacggtgacaactacgttttggatgatttctactgggctgcttgcgaattgtacgctactactggttccgacaagtacttgaactatatcaagtcttctaagcactacttggaaatgccaactgaattgactggtggtgaaaacaccggtattactggtgctttcgactggggttgtactgccggtatgggtactatcactttggctttagttccaactaagctaccagccgctgacgttgctaccgccaaggctaacattcaagctgccgctgacaagttcatctctatttcaaaggcccaaggttacggtgtcccattggaagaaaaggtcatttcttccccattcgatgcttccgttgtcaagggttttcaatggggttctaactccttcgtcattaacgaagctatcgtcatgtcttacgcttacgagttctccgatgtcaacggtactaagaacaacaagtacatcaacggtgctttgactgctatggactacttgttgggtagaaacccaaacattcaatcctatatcaccggttacggtgataacccattggaaaacccacaccacagattctgggcttaccaagctgacaatactttcccaaagccacctccaggttgtttgtccggtggtccaaactctggtttacaagatccttgggtcaagggttctggttggcaaccaggtgaaagaccagccgaaaagtgtttcatggacaacatcgaatcttggtctactaacgaaattaccatcaactggaacgctccattggtttggatttcagcctacttggacgaaaagggtccagaaatcggtggttctgtcactccaccaaccaacttgggtgacgttaacggtgacggtaacaaggacgctttggacttcgctgctttgaagaaggctttgttgtctcaagacacttccaccatcaacgttgctaacgctgatatcaacaaggacggttccatcgacgctgttgacttcgctctattgaagtctttcttgttaggtaagatcactttgggtggtggttctggtggtggttcc

SEQ ID NO: 170 - DNA, 1488 bp, Clostridium cellulolyticum
atggtttcctttacttctttgttggctggtgttgctgctatctccggtgttttggctgccccagctgctgaagttgaaccagtcgctgttgaaaagagagaagctgaagctgaagcttacgacgcttccttgatcccaaacttacaaatcccacaaaagaacatcccaaacaatgatggtatgaacttcgttaagggtctaagattgggttggaacttgggtaacacctttgacgccttcaacggtactaacattaccaatgaattggattacgaaacttcctggtccggtatcaaaaccactaagcaaatgattgacgctattaagcaaaagggtttcaacactgttagaatcccagtatcctggcacccacacgtttccggttctgactacaagatctctgacgtctggatgaacagagttcaagaagttgttaactactgtattgacaacaagatgtacgttatcttgaacacccaccatgacgtcgacaaggtcaagggttacttcccttcttcccaatacatggcctcttctaagaagtacattacctctgtctgggctcaaatcgccgcccgtttcgctaactacgacgaacatttgatattcgaaggtatgaacgaaccaagattggtcggtcacgccaatgaatggtggccagaattgaccaactctgatgtcgtcgactctattaactgcattaaccaattgaaccaagacttcgttaacaccgtcagagctaccggtggtaagaacgcttctagatatttgatgtgtccaggttacgttgcttctccagatggtgctaccaacgactacttcagaatgccaaacgacatttccggtaacaacaacaagatcatcgtttctgttcatgcttactgtccatggaacttcgccggtttagccatggctgacggtggtaccaacgcttggaacattaacgattctaaggatcaatccgaagtcacctggttcatggataacatttacaacaagtacacctctagaggtattccagtcattattggtgaatgtggtgctgttgacaagaataacttgaagaccagagttgaatacatgtcctactacgttgctcaagctaaggctagaggtatcttgtgtattttgtgggataacaacaacttctctggtaccggtgaattgttcggtttcttcgacagaagatcctgtcaattcaagttcccagaaatcatcgacggtatggttaagtacgccttcgaagctaagaccgatccagacccagttatcgtttatggtgactacaacaacgatggtaacgttgacgccttggacttcgctggtttgaagaagtacattatggctgctgaccacgcttacgtcaagaacttggacgttaatttggacaacgaagttaacgctttcgatttggccatcttgaagaagtacttattgggtatggtttctaagctaccatccaacggtggtggttccggtggtggttct

SEQ ID NO: 171 - DNA, 2622 bp, Clostridium cellulolyticum
atgaaaaaaagggtattaaaaaaaatagcaatgcttatggtaatagtgtttgtcctatcttcatgtgcactacaagcatttgcagttgagtatgaaggtgccggcgacttgattcggaatcacacctttgacaacggagtagggtttccgtggcgtgtggttgaatcataccctgcaacagctgattacgatattacagcagacggtaagtacaaaataacaattacaaagattggagctgcaggaataggacaaagatgggatgttcagttccttcacagaggactctcattagtgaatggacatacttatactataaagtttacagttactgccagcagagcttgtaaaatctaccccaaaataggtgaccagggtgatccgtatgaagaatactggaatatgaatcagcaatggcaattccttgaattacaggctaatgttcctaaaactgtaactgcgacatttatacagactaagggagataagaagaacgttgaatttgcttttcaccttgctccagatatatgtacatctgaagcacagaatcctgcaagttttcaacctataacatttacttttgatgacatttatgttgcggatccacagtttgctggatatcctgctcctatccctgaacctactaacgttgtacgtttaaatcaggaaggtttctatcctaatgctgataagattgcaacagtagtatcaagttcaacaactccaattaactggcagttggttaatagtgcaggaacagcagttttaaccggtaaatcaactgttaagggtgctgaccatgcgtctggtgacaatgttcatatcattgatttctcaagttacaaaacagctggaactggctacaaaatagtaacagatgttcctgtaacaaatatcggagataacggaagtatgcccttcaatataagtaatgatatttattccaaaatgaaatatgactcaatgaagtatttctatcacaatagaagtggtattccaataaaaatgccattctgtgatcaaccgcaattagctcgccctgccggacacacaaatgatatactggctcccgacccaacaaaggattacagagcaaactatacacttgatgtaacaggtggttggtatgatgcaggagactttggtaaatacgtggttaaaggtggtatttctacttggactcttatgaattcatatgagcgtgcactttacttgggagacacttcagttgtcccattcatagacggttcattgaacattcctgaaagcggcaatggcttcccggatattcttgatgaagctcgttacaatttgaatactttattgaacatgcaggtaccgacaggaaatacattggctggtatggttcattacaaagctggtgacgagcgttggctacaacttgccatacgtcctgaccaggatactatgaagcgttacttgcagcctccaagtactgctgctaccttgaaccttgctgcaatagctgcacagggttcacgtctctggaagcaatatgatgctgcttttgcaactaagtgtttgactgcagcagaaaccgcatgggatgcagctgttgaacatcctgataaatatatttatatcaatagtgtcactggtattggaactaatggtgaaaactattttttggatgatttctactgggcagcttgtgaattgtatgctactacaggcagtaacaaatatttgaactacataaatagctcacctcattacctccaggaaccttctgaattaacagctggagatatgggatttacaggatgtttcgacttggataatacagctggtatgggaacaataactcttgctctcgttcctaatggtttacctgcagctgatatagctaaagctaaagcaaatattcagactgcagctgataagtttatatcaatagaaaaagcacagggttatggtgttccaatagaagaaaaagtaatttcttctcgttttgatcaatccacagtttcaggtttcccttgtggatcaaactcattcgttattaatgaagcaattgttatgtcatatgcttatttattcagcaataagaacactaaatatatcaatggtgcaataacagctatggattacatccttggacgtaacccaaatgtacagagctatgtaactggttatggtgataacccccttgaaaatccgcatcaccgtttctgggcatatcaggcagacaactcattcccgcatccacctgccggatgtatgtcaggtgggcctaactcaggattacaagactcttgggttaagagcttagggtggcaaccgggtaaagtagcttcagaaaaatgctttttggataatattgagtcttggtcaacaaacgaaatagccataaactggaatgccccactggcatgggtgtcagcttttctggatgaagaaggacgggtgatttgtggtggtgatacccttggagatatcaacggggacggacaaagggatgctttagactttgcattaataaagaaggctcttttgaatggagatacttcaattcaaaacgctgacgtaaacaatgatggaagtgttgatgctatggacttggcattatataagtcattcttattaggaaaagtcaatttc

SEQ ID NO: 172 - DNA, 2211 bp, Clostridium cellulolyticum
atggtttcattcacttccttgttagctggtgtcgctgctatctccggtgttttagctgctccagctgctgaagttgaaccagtcgcagttgaaaagagagaagctgaagctgaagctgctggtacttacaattacggtgaagctttgcaaaagtctatcatgttctacgaatttcaaagatctggtgacttgccagccgacaagagagacaactggagagacgattccggtatgaaggatggttctgacgttggtgtcgatttgactggtggttggtacgacgccggtgaccacgtcaaattcaacttgccaatgtcttacacctcagccatgctagcttggtctttgtatgaagacaaggacgcctacgacaagtcaggtcaaaccaagtacattatggacggtatcaaatgggctaacgattacttcattaaatgtaacccaactccaggtgtttactactaccaagtcggtgatggtggtaaggaccattcctggtggggtccagctgaagtcatgcaaatggaaagaccatccttcaaggtcgacgcttctaagccaggttcagctgtttgcgcttcaaccgctgcctctttggcttctgctgccgtcgttttcaagtcttctgacccaacctacgccgaaaagtgtatctctcatgctaagaacttgttcgatatggctgacaaggctaagtctgatgctggttacactgccgcttctggttactactctagctcctctttctacgacgatttgtcttgggctgctgtttggttgtacttggctaccaacgattctacttacttggataaggctgaatcttacgttccaaactggggtaaggaacaacaaaccgacatcatcgcttacaaatggggtcaatgttgggacgacgttcactacggtgccgaactattgttggctaagttgaccaacaagcaattgtacaaggactccatcgaaatgaacctagacttttggaccaccggtgtcaacggtactagagtttcttacaccccaaagggtttggcttggttgtttcaatggggttctttgagacatgctaccacccaagctttcttggctggtgtttacgctgaatgggaaggttgtaccccatctaaggtctccgtttacaaggacttcttgaagtcccaaatcgactacgctttgggttctaccggtagatcttttgtcgttggttacggtgttaacccaccacaacacccacaccatagaaccgctcacggttcttggactgaccaaatgacttctccaacttaccacagacacaccatctacggtgccttggtcggtggtccagacaacgctgacggttacaccgacgaaatcaacaactacgttaacaacgagatcgcttgcgattacaacgctggttttactggtgctttggctaagatgtacaagcactccggtggtgatccaattccaaacttcaaggccatcgaaaagatcaccaacgatgaagtcattatcaaggctggtttgaactccactggtccaaactacaccgaaatcaaagccgttgtttacaaccaaaccggttggccagctagagtcaccgataagatctctttcaagtacttcatggacttgtctgaaattgtcgctgccggtattgaccctttgtccttggttacttcctctaactactccgaaggtaagaacaccaaagtctctggtgttttgccatgggacgtctccaacaacgtctactacgtcaacgttgacttgaccggtgaaaacatttacccaggtggtcaatctgcttgtagaagagaagttcaattccgtatcgctgctccacaaggtagaagatactggaacccaaagaacgatttctcttacgatggtctaccaaccacctctactgttaataccgttaccaacattccagtttatgacaacggtgttaaggtcttcggtaacgaaccagccggtggttctgaaaacccagatccagaaattttgtacggtgacgtcaactctgacaagaacgtcgacgctttagatttcgccgccttgaagaagtacttgttgggtggcacttcctctattgatgttaaggctgctgatacttacaaggacggtaatatcgacgccattgacatggctaccttgaagaagtacctattgggtaccatcactcaattgccacaaggtggtggcggttctggtggcggttct

SEQ ID NO: 173 - DNA, 1818 bp, Clostridium cellulolyticum
atggtttctttcacctccttgttggctggtgttgctgcaatctccggtgtcttggctgctccagctgccgaagtcgaaccagttgctgtcgaaaagagagaagccgaagctgaagccattaactctcaagatatggtcaagaagatgggtatcggtatgaacttgggtaacaccttcgatgctccaactgaaggttcttggtccaaggctgcccaagaatactacttcgatgacttcaagcaagctggtttcaagcacgttaggattcccattcgttgggaccaacacaccttggctaactctccatacactgttgactctaacttcttgaaccgtattgaaactgttattgactggtctttgtctcgtggtttcgtcactgtcatcaactctcaccacgacacctggttgatggacaactactctcaaaacatcggtagatttgaaaagatttgggaacaaatcgcccaaagattcaaaggtaagtctgaaaacttggtcttcgaaatcttgaacgaaccacacggtaacatcaccgactctcaaatcaacgatatgaataagagaattttgaacattattagaaagaccaacccaactcgtaacgtcatcatcggtgctggttactggaactcttacaactctttatctcaattggaaatcccaaacgacccaaacttgattgctaccttccactactacgacccatactctttcacacaccaatggcaaggtacctggggtaccaagaacgacatggacgccatcgctatggttttcaaccacgttaagaagtggtccgataagaataacattccagtctatttgggtgaatacggtgtcatgggtcactctgacagaacctcagctgtcaaatggttcgacttcgtctccgatcaagccatctcccatggtttctcttgcggtgcttgggacaacggtgtcttcggttctgttgacaacgacatggccttctacaacagagataccagacaatttgacaaagaaattttgaatgccatcttgactactggtaccacctacgactggaccccaccaaccgaaaccaacccagacccaccaagaactccagccaccccagcttacggtgaacaattgattgaagatttcgaaggtgccatgcaatgggctgcctactctggtgttgacgctaccgcttcctgtaagatctcttccggtaagtccaacaacggtttggaaattacctacgctggttcttctaacggttactggggtgttgttgacaacgagcacagaaaccaagattgggaaaagtggcaaaagatctcttttgacattaagtcttcaaacactaacgaagttagattgttaatcgctgaacaatctaagattgaaggtgaagacggtgaacactggacctacgttatcaagccatctacttcctggactaccattgaaattccattctcttctttcactaagagaatggattaccaaccaccagctcaagacggttctgaaaccttcgacttgtacaaggtcggttcattgcacttcatgtactctaactccaactccggtactttaaacattgacaacattaaattgatcggtttgccagaagaacaaatcggtggtaaaattggtgatgttaacgaagatggtaacatcgacgctattgactttgctttattgaagaagtacttgttagactcctctatctctatcaacaaggttaacgccgacattaatttggacggtgatatcaacgctatcgacttcgctaagttgaagatgatgttgttgggtgacggtggtggttctggtggtggctct

SEQ ID NO: 174 - DNA, 1425 bp, Clostridium cellulolyticum
atggtctccttcacttccttgttggctggtgtcgctgccatttctggtgttttggccgctccagctgccgaagtcgaaccagttgctgttgaaaagagagaagctgaagctgaagctgctgatcaaatcccattcccatacgacgctaagtacccaaacggtgcctactcctgtttggctgattctcaatctatcggtaacaacttggtcagatctgaatgggaacaatggaagtctgctcacattacttccaacggtgctagaggttacaagagagttcaaagagacgctaccaccaactacgacaccgtttctgaaggtttgggttacggtttgttgttgtctgtctacttcggtgaacaacaattgttcgacgatttgtacagatacgttaaggttttcttgaactctaacggtttaatgtcttggagaatcgactcttctggcaacattatgggtaaggactctattggtgccgctaccgacgctgatgaagacatcgctgtttccttggttttcgctcacaagaagtggggcacttctggtggtttcaactaccaaaccgaagctaagaactacattaacaacatttacaacaagatggttgaaccaggtacttatgtcatcaaggctggtgacacttggggtggttccaacgttactaacccatcttacttcgctccagcttggtacagaatcttcgctgacttcaccggtaactccggttggatcaacgtcgctaacaagtgttacgaaatcgctgataaagcccgtaattctaacaccggtttggtcccagactggtgtactgccaacggtaccccagcctctggtcaaggtttcgacttctactacgacgccattagataccaatggagagctgccatcgactactcttggtacggtactgctaaggctaagacccactgtgacgctatctctaacttcttcaagaacatcggttacgctaacatcaaggatggttacaccatctccggttctcaaatctcctccaaccacactgccactttcgtctcttgtgccgctgctgctgctatgactggtactgacaccacctatgctaagaacatctacaacgaatgtgttaaggttaaggattctggtaactacacttacttcggtaacaccttgagaatgatggtgttgttatacactaccggtaacttcccaaatttgtacacctacaactcccaaccaaagccagacttgaagggtgacgtcaataacgatggtgctatcgacgccttagatattgctgccctaaagaaggccatcttgacccaaaccacttccaacatttctttgactaacgcagatatgaacaacgacggtaacattgatgctattgactttgctcaattgaaggttaagttattgaacggtggtggttctggtggtggttct

SEQ ID NO: 175 - DNA, 1185 bp, Thermobifida fusca
atgggtctccccgtctccgtccacaggagtgacacaaaaatgagggtgggccgatacatcgccatcacggttggggcctccgcgctgctcgtctccggggtggcgccggcggcggcgggtacgctgccgacgtccgggacggccgccggcgcggcgtcgcaggccgggcacgatcagaagcaggtaccgctccgcaaggtggcgccgaagggcttcgcgatcggcgtggccgtcgcgggtggtggccaccatctggaccaggagtacccggaccccttcaagtacgacgaggagtaccggggggtgctcgccaagcacttcaactcggtcactcccgagaaccacttgaagtgggacttcgtgcacccggagcggaaaaagtacaacttcgggcctgctgaccagatcgtcaagtttgcccagagcaacgggcagaaggtgcgcggccacacgctggtctggcacagccagaaccccgactggctcaccaaggggaagttcagcaagaaggagctccgcaagatcctcaaggagcacatcatcacggtggtgggccgctaccggggcaagatccaccagtgggacgtggccaacgagatcttcgacgacaacggtaagctccgcacgaacgagaacatctggctgaagaacttcgggccggagatcatcgccgacgcgttccgctgggcccaccaggccgacccgaaggcgaagctgttcctcaacgactacggcgccgagggcatcaacaagcgcagcgacgcctacctcaagttcatgaaggagctgcgcaagaagggcgtgccggtacacggcttcggcgtgcaggggcacctgagcctggcctacccgttcccgggcgacatggcgaagaacctcaagcggttctcggacgccgggttcgaggtcgcggtcaccgaggtcgacgtgcgcatcccgctcaacggcggcgacgccactgaagcccagctcaagacccaggccgactactaccgccgcgccctggaggcctgcctgagcgtcaagagctgcaactccttcaccctctggggcaccacgaacaagtactcgtgggtgccggtgttcttcccggacgagggcgaggcgacgatcttctgggacgacttctcccccaagcccgcgtacaccgccctgcaggaggccctggcgaaggcccgccgccgc

SEQ ID NO: 176 - DNA, 1014 bp, Thermobifida fusca
atgaaccatgcccccgccagtctgaagagccggagacgcttccggcccagactgctcatcggcaaggcgttcgccgcggcactcgtcgcggtcgtcacgatgatccccagtactgccgcccacgcggccgtgacctccaacgagaccgggtaccacgacgggtacttctactcgttctggaccgacgcgcccggaacggtctccatggagctgggccctggcggaaactacagcacctcctggcggaacaccgggaacttcgtcgccggtaagggatgggccaccggtggccgccggaccgtgacctactccgccagcttcaacccgtcgggtaacgcctacctgaccctctacgggtggacgcggaacccgctcgtggagtactacatcgtcgaaagctggggcacctaccggcccaccggtacctacatgggcacggtgaccaccgacggtggtacctacgacatctacaagaccacgcggtacaacgcgccctccatcgaaggcacccggaccttcgaccagtactggagcgtccgccagtccaagcggaccagcggtaccatcaccgcggggaaccacttcgacgcgtgggcccgccacggtatgcacctcggaacccacgactacatgatcatggcgaccgagggctaccagagcagcggatcctccaacgtgacgttgggcaccagcggcggtgacaaccccggtgggggcaacccccccggtggcggcaacccccccggtggcggtggctgcacggcgacgctgtccgcgggccagcagtggaacgaccgctacaacctcaacgtcaacgtcagcggctccaacaactggaccgtgaccgtgaacgttccgtggccggcgaggatcatcgccacctggaacatccacgccagctacccggactcccagaccttggttgcccggcctaacggcaacggcaacaactggggcatgacgatcatgcacaacggcaactggacgtggcccacggtgtcctgcagcgccaac

SEQ ID NO: 177 - DNA, 1323 bp, Thermobifida fusca
atgtcccccagacctcttcgcgctcttctgggcgccgcggcggcggccttggtcagcgcggctgctctggccttcccgtcgcaagcggcggccaatgattctccgttctacgtcaaccccaacatgtcctccgccgaatgggtgcggaacaaccccaacgacccgcgtaccccggtaatccgcgaccggatcgccagcgtgccgcagggcacctggttcgcccaccacaaccccgggcagatcaccggccaggtcgacgcgctcatgagcgccgcccaggccgccggcaagatcccgatcctggtcgtgtacaacgccccgggccgcgactgcggcaaccacagcagcggcggcgcccccagtcacagcgcctaccggtcctggatcgacgaattcgctgccggactgaagaaccgtcccgcctacatcatcgtcgaaccggacctgatctcgctgatgtcgagctgcatgcagcacgtccagcaggaagtcctggagacgatggcgtacgcgggcaaggccctcaaggccgggtcctcgcaggcgcggatctacttcgacgccggccactccgcgtggcactcgcccgcacagatggcttcctggctccagcaggccgacatctccaacagcgcgcacggtatcgccaccaacacctccaactaccggtggaccgctgacgaggtcgcctacgccaaggcggtgctctcggccatcggcaacccgtccctgcgcgcggtcatcgacaccagccgcaacggcaacggccccgccggtaacgagtggtgcgaccccagcggacgcgccatcggcacgcccagcaccaccaacaccggcgacccgatgatcgacgccttcctgtggatcaagctgccgggtgaggccgacggctgcatcgccggcgccggccagttcgtcccgcaggcggcctacgagatggcgatcgccgcgggcggcaccaaccccaacccgaaccccaacccgacgcccacccccactccgacccccacgccgcctcccggctcctcgggggcgtgcacggcgacgtacacgatcgccaacgagtggaacgacggcttccaggcgaccgtgacggtcaccgcgaaccagaacatcaccggctggaccgtgacgtggaccttcaccgacggccagaccatcaccaacgcctggaacgccgacgtgtccaccagcggctcctcggtgaccgcgcggaacgtcggccacaacggaacgctctcccagggagcctccacagagttcggcttcgtcggctctaagggcaactccaactctgttccgacccttacctgcgccgccagc

SEQ ID NO: 178 - DNA, 1857 bp, Thermobifida fusca
atgggcagaatgacccccctgacgcgacgactgcgtgccggagcagccgcgatcgcgatcggagcgtctgctcttatccccctgacttcctcccccgcagccgcctcaggcaccgctgactggctgcacacggacggcaaccggatcgtggactccgcgggcaacgaggtgtggctcaccggagccaactggttcggcttcaacaccagcgaacggatgttccacgggctgtgggccgccaacatcgaggacatcaccagtgcgatggccgagcgcggcatcaacatcgtgcgtgtccccatcagcacccaactgctgttggagtggaagaacggccaggccggaccgagtggagtcaacgagtacgtcaaccccgaactggcggggatgaacaccctcgaagtgttcgactactggctgcaactgtgcgaagagtacggcctcaaagtcatgcttgacgtgcacagcgcggaggccgacaactccgggcactactacccggtctggtacaagggcgatatcaccaccgaggacttctacacggcctgggagtgggtcaccgagcggtacaagaacaacgacaccatcgtcgccgcagacatcaagaacgagccccacggcaaagccaacgagaccccgcgcgccaagtgggacggctccacggacatcgacaacttcaagcacgtctgcgagaccgccggtaagcgcatcctcgcgatcaacccgaacatgctcatcctgtgcgaggggatcgagatctaccccaaggatgggcaggactggtcctcgaccgatgggcgggactactactccacctggtggggcggcaacctgcgcggcgtcgccgaccaccccgtcgacctgggcgcccaccaggaccagttggtctactcgccgcacgactacggtcccagcgtgttcgagcagccctggttcgaaggcgagtggaaccggcagaccctgaccgaggacgtgtggcgtcccaactggctctacatccacgaagacgacatcgctccgctgctcatcggcgagtggggcggcttcctggatgggggcgacaacgagaagtggatgacggcgctgcgctcgctcatcatcgacgagaagctgcaccacaccttctgggcgctgaacccgaactcgggtgacaccggcggcctgctcaactacgactggacaacctgggacgaggccaagtacgcgttcctcaagcctgcgctgtggcaggacgccaacggcaagttcgtcggcctggaccacgatgtgccgctgggcggggtgggctccaccaccggtgtgtcgctgaaccagtactacggcgggggcggaccgagccagccgcccacggaacccacggagccgccgacggagcccacggagccgccgacggagccgacggagccgcccgccaaccccacgggtgcgctcgaggtctactaccgcaacaacagtcttgcggccgacgacagccagatcgcgccggggctgcgtctggtcaacaccggaagcagcacggtcgacctggctgacgtggaaatccactactacttcaccaacgagcccggcggtaccctccagttcacctgcgactgggctcaagtgggctgcgccaacgtcaacgcgtccttcacgtcgctgtcggctccgggcgccgacacctccctggtgctcaccctcagcggcagcctcgctcccggggcgagcaccgagctccaaggccggatccacaccgcgaactgggcgaacttcgacgaaagcgacgactacagccgcggcaccaacactgactgggagctcagcgaggtgatcaccgcatacctcggcggcaccctggtctggggtacgcctcccgcc

SEQ ID NO: 179 - DNA, 2784 bp, Thermobifida fusca
atgaccgaacccttccgcgaccccaccctgcccccacacgaacgcgtccgcgacctcctagcccgactcaccaccgaagaaaaaatcggcctcctccaccaataccaacgccccatcccccgactcggtatcgcatctttccgcaccggaaccgaagcactccacggcctcgcctggcacggaccagccaccgtcttcccccaagccatcggcctcgccagcacctgggaccccgacctcgtccaacaagtcggcgcagccaccgccgccgaagtcctcgtcttccacaccaaaaaccccgccactgtcggccgcaacgtctgggcccccgtcgtcaaccctctccgcgacccccgctggggccgaaacgaagaaggctactccgaagacccctggctcaccggagtcatggccgtctcctacgcccgcggcctcgccggaccccacccccaccgcatggacaccgcccccaccctcaaacacttcctcgcctacaacaacgaaaccgaccgctgcaccagctccagccacctccccccacgcgtcctccacgaatacgaactccccgccttcctccccgccctccgcgaaggcgtcgcagtcgccgtcatgccctcctacaacctcgtcaacggccgccccgcccacctcagcccactcatcaacgacgtcctccgcgccgccgcccccgacgaactcatggtcgtcagcgacgccatggcccccggcaacctcgtcgacccccagcactactacgacgaccacgccaccgcctacgcgcacgccctccgcgccggaatcgacagcttcacccaagacgacgaccgcgccgaagccactctcgcccacctccgcgacgccctcgaccgcggcctcatcaccgaagaagacctcgaccgcgcagccacccacatcctgtcggtccgcgtccgcctcggcgaattcgaccccgaacccctccgccgcgtcgaccccgacaccgtcaacagccccgcccaccaagccctcgcccgcaccgcagcccgccgctccatcgtcctcctcaaaaacgacggcatcctccccctccgcgacccccgccgcatcgccgtcatcggccaactcgccgacaccctcatggaagactggtacagcggcaccctcccctacgccatcaccgcccgcgccggcctcgccgaacgcaccgaaaccgtgttctgcgaaggcgtcgaccgcatcgcgctccgcaccaacgagggctacctcaccgccagcgccgacggcacccccatgaccatcacccccgcccccggcttcggccccgtcgccgaatccgccgccttcgacctcttcgactggggcggcgcctgggccctccgcgccgtcgtcaacggccgctacgtctccgaagacgaaaacggccacctcaccaacgaccagcccgggcccaacggctgggaagtccgccaaaccttccgctggcaacccgaccccaacggcaccggcgtcctgcaacacatcgccaccggccgctacgtcgccgtcggcgacaacaacaccgtcaccctcaccccggacgccgacagcgccgccgtcttcgccatcgacaccctccgctccggcgccaccgaagccgccgccatcgccgccaccgccgaagtcgccatcgtcgtcgccggcgaccaccccctcgtcaacggacgcgaaaccgaagaccgcaccgatctcgacctgcccgccgcccaagaaaaagtgctccgcgccgtccgcgccgccaaccccgccaccgtcctcgtcctcaccagcggctacccgttcggcatcgtgtgggccgacgaacacatccccgccatcctctggtcagcccacggcggccaagaatacgggcgcgccctcgccgacgtcctcttcggcgacgccgaccccaccggacgcctcacccaaacctggtaccgctccgcagccgaactccccgacctgttcgactacgacatcatcgccaacgacgccacctacctgtactacctcggctccccgctctaccccttcgggcacggactcagctacaccaccttcgactacaccgaccctgaagtccacgtcaccgacgaccacgtcaccgtccacgtcaccgtcaccaacaccggcgaccgcttcggtgaagaagtcgtccagtgctacacccaccagcgggtctcccgcgtcaaacaaccactccgcaaactccaaggattcgcccgcgtcgccctccaccccggcgaaacccgccgcgtccgcatcgacttccccatccacgcgctcgccatctgggacgtcacccgatcccggttcgtcgtcgaagacgcaccccgcaccgtccacctcggacgctccgccaaagacctgcgggtctgcgcccccctcaacgtccccggcgaacccatcggcccccgccccgccacccggctccacgccgccgacaacgacgaataccacggcgtcgtgctgtgcgccgccgccaaagaccgcggagacgcggtacgcgccaccgaacccggcgcctggatcgccttcctcgacgtggacttcacccccgcccccaaggaagccgtcatctgcgccaacaccgaccagccaggcacactcaccctgcgcatcgacaacccgatcagcggccccaccgtcgccaccgccgacatccccgccgccaccgaccacttcgacttcaccgaagtccgcatccccgtcgacagcgtcacccgccgacacgacctctacatcgtgttcgaagccgcaggtaccgccctctcctggatcgacctgtcc

SEQ ID NO: 180 - DNA, 1389 bp, Thermobifida fusca
atgagcaacgaccacctccccgagttcccggccggattctggttcggcgcggctacggccagctaccagatcgagggtgcggtccacgcggacggacgcggcccgtccatctgggacacctacagccacacaccgggcctggtcctcaacggcgacaccggcgacgtggcctgcgaccactaccaccgctaccccgaggacgtggagctcctgcgccgcctgggggtggacgcctaccgcttctccatcgcctggccgcgcgtcatgcccacgggatcaggcgacgtcaaccagcgcggcctggacttctacgaccgtctcgtcgatgcgctgctcgaagcggggatcaccccggtgcccaccctctaccactgggacctgccgcaggccctggaggatgccggcggctggcgttcccgcagcaccgcggagcacttcgccgcctacacccgggcggtcgttgcccgtctcggcgaccggatccgccactggatcacgctcaacgagccgttctgcagcgctttcctgggctatgccgtgggccggcacgcccccggggcccgggaaggcacgcctgcgctcgccgccgcgcaccacctgctcctcgcccacggcctggcagtgcaggaactgcgcgctgccgatgcgggcgaggtcggcatcaccctcaaccccgaccggatcctgcccgcctccgacagtgcggccgaccgcgcggctgccgaccgcgcggaaaccctgcacaaccgggtctggttcgacccgctgttcgccggccgctaccccgcgaacgaagccgacgtgtggggagagctcgcggacggctcgtaccggcgcgacggcgacctggagatcatcggccagccgctggacttcctcggcatcaactactaccggccgctcaaagtcgccgacggcccgctgaccgaagccgacccggcacgccgcaccgccgtagacatccgcgcccaccagcagcgtttcgatggagtgcggcacacagccatggactggccggtcgtccccgaatccttcacggacctgctgctggacctcacggagcgctacccgaaccttccgcccatctacatcacagagaacggctcagccgagcacgacgtcgtctcccctgacggacgggtgcacgacacggaccgcatcgcctatctcaacgaccacctgcatgccctggccgcggcgatccgcgccggggtggacgtgcgcggctacttcgtctggtcgctgctcgacaacttcgagtgggcgttcggatacgagcggcgtttcggcatcgtccgggtggactacgacaccttggaacggcttccgaaggacagctacttctggtatcagcggctcatcgagcaccaccgcgcccgccaccgcggc

SEQ ID NO: 181 - DNA, 2952 bp, Thermobifida fusca
atgagatcgttactgtctccccggcgctggcgcacgctggcctcgggggcgctcgcagcggccctggccgccgctgtactctcccccggcgtcgcgcacgccgccgtcgcctgctcggtggactacgacgactccaacgactggggtagcgggttcgtcgccgaagtcaaggtgaccaacgaaggcagcgaccccatccagaactggcaagtaggctggaccttccccggtaaccagcagatcaccaacggctggaacggcgtgttcagccagagcggcgccaacgtcaccgtccgctacccggactggaaccccaatatcgcccccggagccaccatctccttcggcttccagggcacctacagcggctccaacgacgccccgaccagcttcaccgtcaacggcgtcacctgcagcggatcccagcccgccaacctgccgcccgatgtcaccctgacatccccggccaacaactcgaccttcctggtcaacgacccgatcgagctgaccgcggtcgcctccgaccccgacggctcgatcgaccgggtggaattcgccgccgacaacaccgtcatcggcatcgacaccacctccccctacagcttcacctggacggacgctgccgccggctcctactcggtgaccgcgatcgcctacgacgaccagggagccaggaccgtctccgctcccatcgccatccgagtgctggaccgggccgccgtcatcgcctcaccgcccaccgtccgcgtgccgcagggcggcaccgccgacttcgaggtgcggctgtccaaccagccctccggcaacgtcacggtcaccgtggcgcgcacgtcgggcagctccgacctgaccgtctccagcggctcccaactccagttcacctccagcaactggaaccagccgcagaaggtgaccatcgcctccgctgacaacggcggaaacctggccgaggcggtcttcaccgtcagcgcccccggccacgactcggccgaggtgacggtccgggagatcgacccgaacaccagctcctacgaccaggccttcctggagcagtacgagaagatcaaggaccccgccagcggctacttccgcgaattcaacgggctcctggtcccctaccactcggtggagaccatgatcgtcgaggctccggaccacggccaccagaccacgtccgaggcgttcagctactacctgtggctggaggcgtactacggccgggtcaccggtgactggaagccgctccacgacgcctgggagtcgatggagaccttcatcatccccggcaccaaggaccagccgaccaactccgcctacaacccgaactccccggcgacctacatccccgagcagcccaacgctgacggctacccgtcgcctctcatgaacaacgtcccggtgggtcaagacccgctcgcccaggagctgagctccacctacgggaccaacgagatctacggcatgcactggctgctcgacgtggacaacgtctacggcttcgggttctgcggcgacggcaccgacgacgcccccgcctacatcaacacctaccagcgtggtgcgcgcgagtcggtgtgggagaccattccgcacccgtcctgcgacgacttcacgcacggcggccccaacggctacctggacctgttcaccgacgaccagaactacgccaagcagtggcgctacaccaacgcccccgacgctgacgcgcgggccgtccaggtgatgttctgggcgcacgaatgggccaaggagcagggcaaggagaacgagatcgcgggcctgatggacaaggcgtccaagatgggcgactacctccggtacgcgatgttcgacaagtacttcaagaagatcggcaactgcgtcggcgccacctcctgcccgggtggccaaggcaaggacagcgcgcactacctgctgtcctggtactactcctggggcggctcgctcgacacctcctctgcgtgggcgtggcgtatcggctccagctcctcgcaccagggctaccagaacgtgctcgctgcctacgcgctctcgcaggtgcccgaactgcagcctgactccccgaccggtgtccaggactgggccaccagcttcgaccgccagttggagttcctccagtggctgcagtccgctgaaggtggtatcgccggtggcgccaccaacagctggaagggaagctacgacaccccgccgaccggcctgtcgcagttctacggcatgtactacgactggcagccggtctggaacgacccgccgtccaacaactggttcggcttccaggtctggaacatggagcgcgtcgcccagctctactacgtgaccggcgacgcccgggccgaggccatcctcgacaagtgggtgccgtgggccatccagcacaccgacgtggacgccgacaacggcggccagaacttccaggtcccctccgacctggagtggtcgggccagcctgacacctggaccggcacctacaccggcaacccgaacctgcacgtccaggtcgtctcctacagccaggacgtcggtgtgaccgccgctctggccaagaccctgatgtactacgcgaagcgttcgggcgacaccaccgccctcgccaccgcggagggtctgctggacgccctgctggcccaccgggacagcatcggtatcgccacccccgagcagccgagctgggaccgtctggacgacccgtgggacggctccgagggcctgtacgtgccgccgggctggtcgggcaccatgcccaacggtgaccgcatcgagccgggcgcgaccttcctgtccatccgctcgttctacaagaacgacccgctgtggccgcaggtcgaggcacacctgaacgacccgcagaacgtcccggcgccgatcgtggagcgccaccgcttctgggctcaggtggaaatcgcgaccgcgttcgcagcccacgacgaactgttcggggccggagctccc

SEQ ID NO: 182 - DNA, 1314 bp, Thermobifida fusca
atgagaatgagaagccggctcgctgcttttggcgcactcgctggcttgactgcaaccctcgccgccgtcacaccggccgaggatgcttacgcgcacggcgcgatgacctaccccccgacgcgtagctacatctgctacgtcaacggcatcgaggggggccagggcggcaacatcgcgcccaccaaccccgcttgccagaacctgcttgcggagaacggcaactacccgttctacaactggttcggcaacctcatcagcgacgctggtggccggcaccgcgagatcatcccggacggccagctctgcggcccccacccgcagttcagcggcctgaacctggtcagcgagcactggcccaccaccacgctggtggccggaagcaccatcaccttccagtacaacgcctgggcaccgcaccccggcacctggtacctgtacgtcaccaaggatggctgggatcccaactccccgctgggttgggacgacctggagcctgttcccttccacacggtcaccgacccgccgatccgtcctggtggccccgagggaccggagtactactgggacgccacgctgcctaacaagtcgggccgccacatcatctactcgatctggcagcgctccgacagcccggaggccttctacgactgcaccgacgtggtgttcgtcggcggcggcgacgacggcggttcgggcggtcctcagccggacactgaggcgcccactgctcccggcaccccggtggctggttccctgaacggcacctccgcccagatcagctggcctgctgcaaccgacaacgtcggtgtcgccgagtaccgggtgtacaacgcggccaacgacgagctgctggccacgactcgcaccaccagcgtcaccctcaccgggctgacgccgaacaccgactactcgatctacgtcgtggcgcgcgacgcggcgggcaacacctcgagcccgtcggcgacgctgaccttcaactcgggtgacgctcccgcgctcgcctgcgagatcgagtacagcacacccaacacctggtacggcggattcaccgcccaggtgcggatctacaacggcagccacgagtccatcgacggctgggaactgacgtgggacttcaccaacggtgagaccatcaaccaggcgtggaacgccactgcccagcagtccggaaccaccgtgacggtcaccaacgtctcgtggaacagcaccattccgcaccacggctcggtggagttcggcttcaacgccaactccacgcgggagccgggagtgccggagaacttcaagctcaacggcagcctctgctccgtggcc

SEQ ID NO: 183 - DNA, 1788 bp, Thermobifida fusca
atgagtaaagttcgtgccacgaacagacgttcgtggatgcggcgcggcctggcagccgcctctggactggcgcttggcgcctccatggtggcgttcgctgctccggccaacgccgccggctgctcggtggactacacggtcaactcctggggtaccgggttcaccgccaacgtcaccatcaccaacctcggcagtgcgatcaacggctggaccctggagtgggacttccccggcaaccagcaggtgaccaacctgtggaacgggacctacacccagtccgggcagcacgtgtcggtcagcaacgccccgtacaacgcctccatcccggccaacggaacggttgagttcgggttcaacggctcctactcgggcagcaacgacatcccctcctccttcaagctgaacggggttacctgcgacggctcggacgaccccgaccccgagcccagcccctcccccagcccttcccccagccccacagacccggatgagccgggcggcccgaccaacccgcccaccaaccccggcgagaaggtcgacaacccgttcgagggcgccaagctgtacgtgaacccggtctggtcggccaaggccgccgctgagccgggcggttccgcggtcgccaacgagtccaccgctgtctggctggaccgtatcggcgccatcgagggcaacgacagcccgaccaccggctccatgggtctgcgcgaccacctggaggaggccgtccgccagtccggtggcgacccgctgaccatccaggtcgtcatctacaacctgcccggccgcgactgcgccgcgctggcctccaacggtgagctgggtcccgatgaactcgaccgctacaagagcgagtacatcgacccgatcgccgacatcatgtgggacttcgcagactacgagaacctgcggatcgtcgccatcatcgagatcgactccctgcccaacctcgtcaccaacgtgggcgggaacggcggcaccgagctctgcgcctacatgaagcagaacggcggctacgtcaacggtgtcggctacgccctccgcaagctgggcgagatcccgaacgtctacaactacatcgacgccgcccaccacggctggatcggctgggactccaacttcggcccctcggtggacatcttctacgaggccgccaacgcctccggctccaccgtggactacgtgcacggcttcatctccaacacggccaactactcggccactgtggagccgtacctggacgtcaacggcaccgttaacggccagctcatccgccagtccaagtgggttgactggaaccagtacgtcgacgagctctccttcgtccaggacctgcgtcaggccctgatcgccaagggcttccggtccgacatcggtatgctcatcgacacctcccgcaacggctggggtggcccgaaccgtccgaccggaccgagctcctccaccgacctcaacacctacgttgacgagagccgtatcgaccgccgtatccaccccggtaactggtgcaaccaggccggtgcgggcctcggcgagcggcccacggtcaacccggctcccggtgttgacgcctacgtctgggtgaagcccccgggtgagtccgacggcgccagcgaggagatcccgaacgacgagggcaagggcttcgaccgcatgtgcgacccgacctaccagggcaacgcccgcaacggcaacaacccctcgggtgcgctgcccaacgcccccatctccggccactggttctctgcccagttccgcgagctgctggccaacgcctacccgcctctg

SEQ ID NO: 184 - DNA, 1398 bp, Thermobifida fusca
atggcgaaatcccccgccgcccggaagggcggccctccggtcgctgtcgcggtgaccgcggccctcgccctgctgatcgcgctcctctcccccggagtcgcgcaggccgccggtctcaccgccacagtcaccaaagaatcctcgtgggacaacggctactccgcgtccgtcaccgtccgcaacgacacctcgagcaccgtctcccagtgggaggtcgtcctcaccctgcccggcggcactacagtggcccaggtgtggaacgcccagcacaccagcagcggcaactcccacaccttcaccggggtttcctggaacagcaccatcccgcccggaggcaccgcctccttcggcttcatcgcttccggcagcggcgaacccacccactgcaccatcaacggcgccccctgcgacgaaggctccgagccgggcggccccggcggtcccggaaccccctcccccgaccccggcacgcagcccggcaccggcaccccggtcgagcggtacggcaaagtccaggtctgcggcacccagctctgcgacgagcacggcaacccggtccaactgcgcggcatgagcacccacggcatccagtggttcgaccactgcctgaccgacagctcgctggacgccctggcctacgactggaaggccgacatcatccgcctgtccatgtacatccaggaagacggctacgagaccaacccgcgcggcttcaccgaccggatgcaccagctcatcgacatggccacggcgcgcggcctgtacgtgatcgtggactggcacatcctcaccccgggcgatccccactacaacctggaccgggccaagaccttcttcgcggaaatcgcccagcgccacgccagcaagaccaacgtgctctacgagatcgccaacgaacccaacggagtgagctgggcctccatcaagagctacgccgaagaggtcatcccggtgatccgccagcgcgaccccgactcggtgatcatcgtgggcacccgcggctggtcgtcgctcggcgtctccgaaggctccggccccgccgagatcgcggccaacccggtcaacgcctccaacatcatgtacgccttccacttctacgcggcctcgcaccgcgacaactacctcaacgcgctgcgtgaggcctccgagctgttcccggtcttcgtcaccgagttcggcaccgagacctacaccggtgacggcgccaacgacttccagatggccgaccgctacatcgacctgatggcggaacggaagatcgggtggaccaagtggaactactcggacgacttccgttccggcgcggtcttccagccgggcacctgcgcgtccggcggcccgtggagcggttcgtcgctgaaggcgtccggacagtgggtgcggagcaagctccagtcc

SEQ ID NO: 185 - DNA, 1848 bp, Thermobifida fusca
atgacccccctgacgcgacgactgcgtgccggagcagccgcgatcgcgatcggagcgtctgctcttatccccctgacttcctcccccgcagccgcctcaggcaccgctgactggctgcacacggacggcaaccggatcgtggactccgcgggcaacgaggtgtggctcaccggagccaactggttcggcttcaacaccagcgaacggatgttccacgggctgtgggccgccaacatcgaggacatcaccagtgcgatggccgagcgcggcatcaacatggtgcgtgtccccatcagcacccaactgctgttggagtggaagaacggccaggccggaccgagtggagtcaacgagtacgtcaaccccgaactggcggggatgaacaccctcgaagtgttcgactactggctgcaactgtgcgaagagtacggcctcaaagtcatgcttgacgtgcacagcgcggaggccgacaactccgggcactactacccggtctggtacaagggcgatatcaccaccgaggacttctacacggcctgggagtgggtcaccgagcggtacaagaacaacgacaccatcgtcgccgcagacatcaagaacgagccccacggcaaagccaacgagaccccgcgcgccaagtgggacggctccacggacatcgacaacttcaagcacgtctgcgagaccgccggtaagcgcatcctcgcgatcaacccgaacatgctcatcctgtgcgaggggatcgagatctaccccaaggatgggcaggactggtcctccaccgatgggcgggactactactccacctggtggggcggcaacctgcgcggcgtcgccgaccaccccgtcgacctgggcgcccaccaggaccagttggtctactcgccgcacgactacggtcccagcgtgttcgagcagccctggttcgaaggcgagtggaaccggcagaccctgaccgaggacgtgtggcgtcccaactggctctacatccacgaagacgacatcgctccgctgctcatcggcgagtggggcggcttcctggatgggggcgacaacgagaagtggatgacggcgctgcgctcgctcatcatcgacgagaagatgcaccacaccttctgggcgctgaacccgaactcgggtgacaccggcggcctgctcaactacgactggacaacctgggacgaggccaagtacgcgttcctcaagcctgcgttgtggcaggacgccaacggcaagttcgtcggcctggaccacgatgtgccgctgggcggggtgggctccaccaccggtgtgtcgctgaaccagtactacggcgggggcggaccgagccagccgcccacggaacccacggagccgccgacggagcccacggagccgccgacggagccgacggagccgcccgccaaccccacgggtgcgctcgaggtctactaccgcaacaacagtcttgcggccgacgacagccagatcgcgccggggctgcgtctggtcaacaccggaagcagcacggtcgacctggctgacgtggaaatccactactacttcaccaacgagcccggcggtaccctccagttcacctgcgactgggctcaagtgggctgcgccaacgtcaacgcgtccttcacgtcgctgtcggctccgggcgccgacacctccctggtgctcaccctcagcggcagcctcgctcccggggcgagcaccgagctccaaggccggatccacaccgcgaactgggcgaacttcgacgaaagcgacgactacagccgcggcaccaacactgactgggagctcagcgaggtgatcaccgcatacctcggcggcaccctggtctggggtacgcctcccgcc

SEQ ID NO: 186 - DNA, 2922 bp, Thermobifida fusca
atgcttaggagacccagatctcgatccccccttgtcgccctcaccgcggcgacttgccgagtcgcgctcgggggtacggcggttcccgcccaggcagacgaagtcaaccagattcgcaacggcgacttcagctccggcaccgcaccctggtggggaaccgagaacatccaactcaacgtcaccgacgggatgctgtgcgtcgacgtccccggcggcaccgtcaacccgtgggacgtgatcatcggccaggacgacatccccctcatcgaaggtgagtcctacgccttctccttcactgcctccagcaccgtccccgtctccatccgcgccctggtgcaagagcccgtggagccgtggaccacccagatggacgagcgtgccctgctcggccccgaggcagaaacctacgaattcgtcttcacctccaacgtcgactgggacgacgcccaagtcgccttccagatcggcggctccgacgaaccgtggaccttctgcctcgacgacgtcgccctgctcggccgcgccgaacccccggtctacgaacccgacaccggaccgcgggtccgcgtcaaccaggtcggctacctcccgcacggtcccaagaaggcgaccgtggtcaccgacgccaccagcgcgctcacctgggagcttgccgacgccgacggtaacgtggtcgccagcggccagaccaagccgcacggcgcggactccagctccgggctcaacgtccacaccgtcgacttcagctcctacaccacgaagggaagcgactacacgctcaccgtcgacggtgaaaccagctaccccttcgacatcgacgaaagcgtctacgaggaactgcgcgtcgacgcgctgtcgttctactacccgcagcgcagcggcatcgagatcctcgactccatcgcccccggctacggacgcccggccggccacatcggcgtgccccccaaccagggcgataccgacgtgccgtgcgcgcccggcacctgcgactactccctggacgtctccggcggctggtacgacgcgggcgaccacggcaaatacgtggtcaacggcggtatctcggtgcaccagatcatgagcatctacgagcgctcccagctcgccgacaccgcccagcccgacaagctggccgactccaccctgcgcctgcccgaaaccggcaacggcgtgcccgacgtgctcgacgaagcacgctgggagatggagttcctcctcaagatgcaggtgcccgaaggcgaaccgctcgccggcatggcgcaccacaagatccacgacgaacagtggaccgggctgccgctgctgccctccgctgacccgcagccgcgctacctgcagccgccgtccaccgcggccacgctgaacctggccgccaccgccgcccagtgcgctcgcgtgttcgaacccttcgacgaggatttcgccgccgagtgcctggctgccgcggaaaccgcgtgggacgccgccaaggccaacccgaacatctacgcgcctgccttcggtgaaggcggcggcccgtacaacgacaacaacgtcaccgacgagttctactgggccgcggccgaactgttcctcaccaccggcaaggaggagtaccgcgacgcggtgacctcgtcgccgctgcacaccgacgacgaagaggtcttccgcgacggcgccttcgactggggatggactgctgcgctggcccgcctccagctggccacgatccccaacgacctcgccgaccgcgaccgggtgcgccagtccgtggtcgatgccgccgacatgtacctcgccaacgtcgagaccagcccgtggggcctggcctacaagccgaacaacggcgtgttcgtctggggctccaacagcgctgtcctcaacaacatggtgatcctggcggtcgccttcgacctcaccggtgacaccaaataccgcgacggcgtgctggaaggcatggactacatcttcggccgcaacgcgctgaaccagtcctacgtcaccggctacggcgacaaggactcccgcaaccagcacagccgctggtacgcccaccagctcgacccccggttgcccaacccgcccaagggcacgctggccggtggacccaactccgactccaccacctgggacccggtggcccagtccaagctgaccgggtgcgccccccagatgtgctacatcgaccacatcgagtcgtggtccaccaacgagctgaccatcaactggaacgcccccctgtcgtggatcgcgtccttcatcgccgaccaggacgacgccggcgagcccggcggagaagagcccggaccgggcgacgacgagaccccgccgagcaagcctgggaacctgaaggccagcgacatcaccgcgaccagcgccaccctgacctgggacgcctccaccgacaacgtcggagtggtcggctacaaggtctccctggtccgcgacggtgacgctgaagaggtgggcaccaccgcgcagaccagctacacgctcaccgggctgagcgcggaccaggagtacaccgtccaggtggtcgcctacgacgcggcaggcaacctctccacgccagccaccgtcaccttcaccaccgagaaggaggacgagactcccacgcccagcgcctcctgcgcggtgacgtaccagaccaacgactggccgggcggcttcaccgcctcggtgacgctgaccaacaccggcagcaccccgtgggactcctgggaactgcgcttcaccttcccgtcgggacagactgtcagccacggctggagcgccaactggcagcagagcggcagtgacgtgaccgccacctccttgccgtggaacggatcagttccgccgggcggcggctcagtcaacatcggcttcaacggaacctggggcggttcgaacaccaaacctgagaagttcaccgtcaacggcgcggtctgctccatcggc

SEQ ID NO: 187 - DNA, 2994 bp, Thermobifida fusca
atgggagcgctcccatggtgggcctccgctgtgaggtcatcctcccagttcgaatccccctacggaaggacttccgtgcttaggagacccagatctcgatccccccttgtcgccctcaccgcggcgacttgcgcagtcgcgctcgggggtacggcggttcccgcccaggcagacgaagtcaaccagattcgcaacggcgacttcagctccggcaccgcaccctggtggggaaccgagaacatccaactcaacgtcaccgacgggatgctgtgcgtcgacgtccccggcggcaccgtcaacccgtgggacgtgatcatcggccaggacgacatccccctcatcgaaggtgagtcctacgccttctccttcactgcctccagcaccgtccccgtctccatccgcgccctggtgcaagagcccgtggagccgtggaccacccagatggacgagcgtgccctgctcggccccgaggcagaaacctacgaattcgtcttcacctccaacgtcgactgggacgacgcccaagtcgccttccagatcggcggctccgacgaaccgtggaccttctgcctcgacgacgtcgccctgctcggcggcgccgaacccccggtctacgaacccgacaccggaccgcgggtccgcgtcaaccaggtcggctacctcccgcacggtcccaagaaggcgaccgtggtcaccgacgccaccagcgcgctcacctgggagcttgccgacgccgacggtaacgtggtcgccagcggccagaccaagccgcacggcgcggactccagctccgggctcaacgtccacaccgtcgacttcagctcctacaccacgaagggaagcgactacacgctcaccgtcgacggtgaaaccagctaccccttcgacatcgacgaaagcgtctacgaggaactgcgcgtcgacgcgctgtcgttctactacccgcagcgcagcggcatcgagatcctcgactccatcgcccccggctacggacgcccggccggccacatcggcgtgccccccaaccagggcgataccgacgtgccgtgcgcgcccggcacctgcgactactccctggacgtctccggcggctggtacgacgcgggcgaccacggcaaatacgtggtcaacggcggtatctcggtgcaccagatcatgagcatctacgagcgctcccagctcgccgacaccgcccagcccgacaagctggccgactccaccctgcgcctgcccgaaaccggcaacggcgtgcccgacgtgctcgacgaagcacgctgggagatggagttcctcctcaagatgcaggtgcccgaaggcgaaccgctcgccggcatggcgcaccacaagatccacgacgaacagtggaccgggctgccgctgctgccctccgctgacccgcagccgcgctacctgcagccgccgtccaccgcggccacgctgaacctggccgccaccgccgcccagtgcgctcgcgtgttcgaacccttcgacgaggatttcgccgccgagtgcctggctgccgcggaaaccgcgtgggacgccgccaaggccaacccgaacatctacgcgcctgccttcggtgaaggcggcggcccgtacaacgacaacaacgtcaccgacgagttctactgggccgcggccgaactgttcctcaccaccggcaaggaggagtaccgcgacgcggtgacctcgtcgccgctgcacaccgacgacgaagaggtcttccgcgacggcgccttcgactggggatggactgctgcgctggcccgcctccagctggccacgatccccaacgacctcgccgaccgcgaccgggtgcgccagtccgtggtcgatgccgccgacatgtacctcgccaacgtcgagaccagcccgtggggcctggcctacaagccgaacaacggcgtgttcgtctggggctccaacagcgctgtcctcaacaacatggtgatcctggcggtcgccttcgacctcaccggtgacaccaaataccgcgacggcgtgctggaaggcatggactacatcttcggccgcaacgcgctgaaccagtcctacgtcaccggctacggcgacaaggactcccgcaaccagcacagccgctggtacgcccaccagctcgacccccggttgcccaacccgcccaagggcacgctggccggtggacccaactccgactccaccacctgggacccggtggcccagtccaagctgaccgggtgcgccccccagatgtgctacatcgaccacatcgagtcgtggtccaccaacgagctgaccatcaactggaacgcccccctgtcgtggatcgcgtccttcatcgccgaccaggacgacgccggcgagcccggcggagaagagcccggaccgggcgacgacgagaccccgccgagcaagcctgggaacctgaaggccagcgacatcaccgcgaccagcgccaccctgacctgggacgcctccaccgacaacgtcggagtggtcggctacaaggtctccctggtccgcgacggtgacgctgaagaggtgggcaccaccgcgcagaccagctacacgctcaccgggctgagcgcggaccaggagtacaccgtccaggtggtcgcctacgacgcggcaggcaacctctccacgccagccaccgtcaccttcaccaccgagaaggaggacgagactcccacgcccagcgcctcctgcgcggtgacgtaccagaccaacgactggccgggcggcttcaccgcctcggtgacgctgaccaacaccggcagcaccccgtgggactcctgggaactgcgcttcaccttcccgtcgggacagactgtcagccacggctggagcgccaactggcagcagagcggcagtgacgtgaccgccacctccttgccgtggaacggatcagttccgccgggcggctcagtcaacatcggcttcaacggaacctggggcggttcgaacaccaaacctgagaagttcaccgtcaacggcgcggtctgctccatcggc

SEQ ID NO: 188 - DNA, 2994 bp, Thermobifida fusca; identical to SEQ ID NO: 187

SEQ ID NO: 189 - DNA, 1431 bp, Clostridium thermocellum
atgaagaacgtaaaaaaaagagtaggtgtggttttgctgattcttgcagtgttgggggtttatatgttggcaatgccggcaaacactgtgtcagcggcaggtgtgccttttaacacaaaatacccctatggtcctacttctattgccgataatcagtcggaagtaactgcaatgctcaaagcagaatgggaagactggaagagcaagagaattacctcgaacggtgcaggaggatacaagagagtacagcgtgatgcttccaccaattatgatacggtatccgaaggtatgggatacggacttcttttggcggtttgctttaacgaacaggctttgtttgacgatttataccgttacgtaaaatctcatttcaatggaaacggacttatgcactggcacattgatgccaacaacaatgttacaagtcatgacggcggcgacggtgcggcaaccgatgctgatgaggatattgcacttgcgctcatatttgcggacaagttatggggttcttccggtgcaataaactacgggcaggaagcaaggacattgataaacaatctttacaaccattgtgtagagcatggatcctatgtattaaagcccggtgacagatggggaggttcatcagtaacaaacccgtcatattttgcgcctgcatggtacaaagtgtatgctcaatatacaggagacacaagatggaatcaagtggcggacaagtgttaccaaattgttgaagaagttaagaaatacaacaacggaaccggccttgttcctgactggtgtactgcaagcggaactccggcaagcggtcagagttacgactacaaatatgatgctacacgttacggctggagaactgccgtggactattcatggtttggtgaccagagagcaaaggcaaactgcgatatgctgaccaaattctttgccagagacggggcaaaaggaatcgttgacggatacacaattcaaggttcaaaaattagcaacaatcacaacgcatcatttataggacctgttgcggcagcaagtatgacaggttacgatttgaactttgcaaaggaactttatagggagactgttgctgtaaaggacagtgaatattacggatattacggaaacagcttgagactgctcactttgttgtacataacaggaaacttcccgaatcctttgagtgacctttccggccaaccgacaccaccgtcgaatccgacaccttcattgcctcctcaggttgtttacggtgatgtaaatggcgacggtaatgttaactccactgatttgactatgttaaaaagatatctgctgaagagtgttaccaatataaacagagaggctgcagacgttaatcgtgacggtgcgattaactcctctgacatgactatattaaagagatatctgataaagagcataccccacctaccttat

SEQ ID NO: 190 - DNA, 2814 bp, Clostridium thermocellum
atgaaattaagatacaaggtaaggcgaagaagaaggattattacatgctgcggcataattgccgccgttatcgttgtttcaactctgataatcacaatcaaaaacagctttaaaccttccagacaatcatccaattcaaatgttacatattccaaagaaaatgttcaatcagtctattccgacaggtttatagctctttttgaagacatccagaaacaaggttatctcagcgaagaaggaattccgtaccattccatagaaacacttttggtggaagctccggactatggacatctcactaccagtgaagccatgagctacatggtctggctcggagcaacctacgggaaacttaccggtgactggacatattttaaagatgcatgggacaagacagaacaatacataatacccgatcccgaaagagaccaacccggcgttaattcatacattccgacccagcctgcccaatatgcgccggaagccgactctcccgaaaaatatccaacaccaggcgatatcaatgcacccacaggcatagatcccattgcagacgaacttgcctcaacttacggtacaaaagccatatatcaaatgcactggctcctggacgttgacaactggtacgggtacggaaatcacggggacggtacaagccgctgttcttatataaacacttatcagagaggctccggtgaatccgtatgggaaacaataccccacccctcgtgggaagactttagatggggacaagtcaacaacggaggatttctaaaactttttggaaacttcggcgagcctgtaaggcagtggcgttacacctcagcctccgatgccgatgcaagacagattcaggcaacctactgggcttacctttggtccaaagagcaaggcaaagaaaaggaacttcagccctattttgaaaaagcggcaaaaatgggtgattatctaaggtatactttctttgacaaatatttcagacctataggggtgcaagacagcggaagagccggcacaggatatgacagctgccattatcttttatcctggtatgcctcatggggaggcgatatcaacggaacctggagctggagaatcggaagctcccattgccatcagggctaccaaaatccgatggccgcctacgcattggcaaaggaatccattttcactccaaaatccaaaaacgctaaaaaggattgggagcaaagtcttgaccgtcagattgaactgtttttgtaccttcaaagtgccgaaggtgccatagccggcggtgtaaccaacagctggtcaggtgcgtacggcaaatatcctgaaggcacaagcacattctacgatatggcttatgatccgcatcctgtttacaatgatccaccgagcaacagatggtttggatttcaggcatggtcaatggaaaggattatggaatactattatcttacaggagacagccgggttaaggaactctgcaaaaaatgggtctcatgggcaatagaaaacacccgtttaaaaagtgacggaacctacgagattccttccaccctggaatggtccggccagcccgacccatggacaggaaaacccagtgaaaataaaaaccttcactgtaccgtcacagagtggacagtggacgtgggagtaaccgcttcatatgcaaaagcgcttatttactatgccgccgccacggaaaaacatgaaaagaaaattgatgacaaagcccgtgaaacagccaaacagcttctcgacagaatgtggcacaattacagggataaaaagggtgtggccgcaaaggaaccaagggctgattacaaacgtttctttgatgaagtttacatccctcatgatttttccggcatcaatgcccagggcgccgaaataaagaacggaataacctttatagatcttcgtccaaaatacaaagaagacaaagattataaaatggtggaagaagccataaaaagcggcaaagatccggtaatgacctatcatcgttactgggcacaggccgaagtggcaatggcaaacgccatgtatcacattttctttgagcagaaaaaagacggactggtaccgggtataaactctgatgacagcaattcatcctctgaaactcaaaaatccgaaacaccggattataccccggacagtttgtcaacctccgatgcaacaataacagaaagtccggcaaacacaaacagcccggatgaaaatccatcaccgcagaacacctcagcaccaaccaacgtaccacttaatcccgccaacactccatataattcatccaacgcagcacccaactcacccaatacaccagccagaccgtccaacacaacagccggatcacccgcaggtaataacaccgtaggcaggttaatactgcaatatgccaacggcaacggttcagatactacaaatactataaatccaaggtttaaactcatcaacaactccggttcacctgttaaactgtcagatgtcaagataagatactattacaccattgatggggaaaaaggtcagcaattctggtgtgactggagctctgcaggaaactccaacgtaaccggaaaatttgtaaaacttacctctcccaaaaacaatgccgactattacctggaaataggctttaccgaaggagcaggaagcatagagcccggcatgagcgtggaagtgcaggcaagattttcaaaggatgactggtccaattacagccaggcaaacgattactccttctctgcatccgccaatgactacggaaattcaaaccacatagccctctatatatccggaaggcttgtatcgggaaacgaaccg

SEQ ID NO: 191 - DNA, 2130 bp, Clostridium thermocellum
atggtgaaaaagacattatgctttgtactgactttggctatgctgacggcatttattcttcctcaggggattgtgtccgcagcaggaagctataactatgcggaagcacttcagaaagccatttacttttatgagtgtcagcaggccggccctctacctgaatggaaccgcgttgagtggcgtggcgacgcaacaatgaatgatgaggtacttggtggatggtatgacgcaggtgaccatgtcaagtttaatctgcctatggcgtattcggcggcaatgcttggctgggctctttatgagtatggcgatgacattgaggcatcggggcagagacttcatcttgaaaggaaccttgcctttgcccttgactatcttgttgcctgcgacagaggtgacagtgtcgtttatcagataggtgacggtgccgctgaccataaatggtggggttctgcggaagttattgaaaaagaaatgacaagaccttactttgtaggaaagggatccgccgttgtaggtcagatggctgcagctttggctgtaggttccatagttcttaaaaatgatacatacctcagatatgcgaagaagtatttcgaacttgcagatgcaacaagaagtgacagcacttatactgctgcaaatggtttctacagttcccacagcggattctgggatgagctgttgtgggcttccacttggctctatcttgcaacaggtgatagaaattatcttgataaagctgagtcctatattccaaaattaaaccgtcagaatcagaccacagatatagaatatcagtgggcacattgctgggatgactgccactatggagcaatgatcttgcttgcaagagctacaggtaaagaagagtatcacaaatttgcacaaatgcatctggattggtggacacctcaaggttataacggaaagagagttgcatatactcccggcggacttgcgcatcttgatacctggggaccgttgagatatgctacaactgaagcattcctcgcttttgtatatgccgattcaataaatgacccggctctcaagcaaaaatattataattttgcgaaaagccagattgactatgcattgggttcaaatcctgacaacagaagctatgtagtcggatttggaaacaatccgccacagcgtcctcaccacagaaccgctcatggaacttggttggataaaagagatattccggaaaagcacagacatgtactttacggtgctctggtcggaggacccggaagagatgacagttatgaagacaatatagaggattatgtaaaaaatgaagttgcctgcgactacaatgcaggttttgtaggcgcgctctgcagattgactgctgaatacggcggaactcctcttgcgaacttcccgccaccggaacaaagagatgatgagttcttcgtagaagcggctataaatcaggcaagtgatcatttcactgaaataaaagcattgctcaacaaccgttcatcctggccggcaagacttattaaggacctttcatacaactattatatggatttgactgaagtttttgaggcaggttacagtgttgacgatattaaagtaacaataggctattgcgaaagcggtatggatgtcgagatttcgccgattactcatttgtatgacaatatttattacataaaaatatcatatatcgacggaaccaatatttgtccgataggtcaggaacagtatgccgctgagcttcagttccgtattgcggcacctcaaggtactaaattctgggatccgacaaatgacttctcatatcagggacttaccagagagttggcaaagacaaaatatatgcccgtttttgacggagcaacaaaaatctttggagaagttccaggcggctttgaaccggttccttcaccttcgccgactcctgctcaatataaagtcggtgacttaaacggtgacggagtggttaattcaactgacagtgtaatattgaaaagacatataattaaattttctgaaataacagatccagttaaattgaaagctgctgatcttaacggagatggcaatataaactccagcgatgtttcattaatgaagagatatctgctccgtataatagataaatttccggtagaa

SEQ ID NO: 192 - DNA, 1029 bp, Clostridium thermocellum
atggtgagttttaaagcaggtataaatttaggcggatggatatcacaatatcaagttttcagcaaagagcatttcgatacattcattacggagaaggacattgaaactattgcagaagcagggtttgaccatgtcagactgccttttgattatccaattatcgagtctgatgacaatgtgggagaatataaagaagatgggctttcttatattgaccggtgccttgagtggtgtaaaaaatacaatttggggcttgtgttggatatgcatcacgctcccgggtaccgctttcaagattttaagacaagcaccttgtttgaagatccgaaccagcaaaagagatttgttgacatatggagatttttagccaagcgttacataaatgaacgggaacatattgcctttgaactgttaaatgaagttgttgagcctgacagtacccgctggaacaagttgatgcttgagtatataaaagcaatcagggaaattgattccaccatgtggctttacattgggggcaataactataacagtcctgatgatcttaaaaaccttgcagatattgatgatgattacatagtttacaatttccatttttacaatccttttttctttacgcatcagaaagcccactggtcggaaagtgccatggcgtacaacaggactgtaaaatatccgggacaatatgagggaattgaagagtttgtgaaaaataatcctaagtacagttttatgatggaattgaataacctgaagctgaataaagagcttttgcgcaaagatttaaaaccagcaattgagttcagggaaaagaaaaaatgcaaactatattgcggggagtttggcgtaattgccattgctgacttggagtctaggataaaatggcatgaagattatataagtcttctagaggagtatgatatcggcggcgcggtgtggaactacaaaaaaatggattttgaaatttataatgaggatagaaaacctgtctcgcaagaattggtaaatatactggcgagaagaaaaact

SEQ ID NO: 193 - DNA, 1683 bp, Clostridium thermocellum
atgaaatgcagatatatggattatttaataaactgtgagttggactctttgcctaatgaaaaatccgaaaaaataaacaaacatataagcacctgcatggactgcagaaattatctgggtgcacttatgatatccaaaaaatatattgccaaagaaccggaaatggataaatatttttacatgcgggttatcaatgccatagaccctgacagatacaagaaatcgaaactgacttttaagattctgtcttcattggaaaggctaaagcctgcttttaaagcgtctttgggaactttggcaatctttgtggcagtagctttgttaataaccggcggaatttttgacaatctcggcaactggattgccaaaagcagcaataaccgctccaataccggtgaaacaacaaacctgacctttttgcgtacagacggtcagaatattgttaccggtaccggtgaaatcttccacataagaggtgttacccttacaaacaacttttggggcaactgggtcaacggagaatcggaaaaattgcaaagtcaaggtatggaccctattatacgccctcttgtacaggatgcctgggtgctcactgatgatgattttgagcgtattaaagacctgggctgcaacacggttttatatgatatcaattaccagctttttgcagaagacaatccaaacagggaagaaaatctcaaaaagctcaaagaacatataaggcgtttttcctcaatggacatatatacggctgttatgctaatggctcctccgggactggattcgatcaatgacgcctacgaaaagtacaaacacggctcagaacgtataaaatctgtgtttgaggatgatacctactacgaacagtgggttgagatgtggaagtatttggccgaagaacttaaagactttaaaggtgtggcaggatatggacttataaaccagccaagagccccgagtgaaagtgaaggtggaatcgggatattcagggaacgcctgaacaatgtatgcagagaaatacgtaaaattgacaaaaatcatatcatatttgttcccgaatataacagcagagaggccaatcccggcgaatcctactggaacgaaaaaacaaatagttatgtaatagacaacggtgagcaaggtattatctgggaaagaggtttggtaaaagttgattcatcaaacgtagtatacttgttccactttttcgaaccatacaactttgtcaatgacggtgtcggagattttgatgccgaaagccttgaagctcaagtcagaaaacgttatgaatgggctaaaaatgtcggcagggctccgcttcttaccgaatacggaatctcccgggtaaacagcgtagacaaacgtgtacaatggcttgaaaccgttcacgacatctttgataaatacggtatctcggcttcatacttccaatataaaaatgccgtaggtgcttttataaatgtgaaaaccggttttaacgctttatacggagaatatgtcagctgggatagtgaaatcggcctgaatcccttttactttgtaaatgaacacgttgccacatccgcaaaagaaaatcattttgatgaagcacttaaagagtattaccttaaaggtaaaaacctgaaaaaaatttcaatactggacaatcagcccattcttgaaacattgcaaaatttttggaaa

SEQ ID NO: 194 - DNA, 2280 bp, Clostridium thermocellum
atgattgtaggaaaagttcttgatatggatgaaaagacggccattataatgactgatgactttgcttttctgaatgtggtaaggacctctgaaatggcagttggtaaaaaagtgaaggttttggactcggatataatcaagcctaaaaattctttgcgcagatatttgccggttgcggcagttgctgcatgctttgtaattgtgttgtcttttgtgctgatgtttattaatggaaatacggcaagaaaaaatatatatgcttatgttggcattgatataaatccaagtattgagctttggataaattacaacaacaaaatagccgaagccaaagcactgaacggcgatgccgagacagtgctggaaggacttgaattaaaagaaaaaacagtggcggaggctgtgaatgagattgtgcaaaagagcatggagcttggatttatttccagggagaaggagaatataatccttatatccacagcctgtgatttaaaagcaggggaaggttcggagaataaggacgttcaaaataaaatcggtcagctttttgatgatgtgaacaaggcggtttcagaccttaaaaacagcggtattacaaccaggattttaaatcttactttggaggaaagagaatcatccaaagaagaaaatatttcaatgggcagatatgccgtgtatttaaaagccaaagagcagaatgtaaatttgactattgatgagattaaagatgcggatttgctggagctcattgccaaggtcggcattgataatgagaatgttccggaggatattgtaacagaggataaagacaacctggatgcgataaataccggacctgcggaaagtgccgtgcctgaagtgactgaaactttgcctgctacctcaacacccggcaggacggaaggtaacaccgcgacaggttcggttgacagtacacctgctttgtccaagaacgaaacaccgggcaaaacagaaacaccgggaaggacattcaatacaccggcaaaatcgtcactggggcaatcttcgacgcccaagccggtatcacccgttcaaacggcaacagcgacaaagggtattgggactttgacacccaggaactcaccgacgccagtaataccttccaccggcattcaatggattgaccaggcaaatgagagaataaatgagattcgaaagagaaatgtacagataaaagttgtggattccagcaacaagccgatagagaatgcttatgtggaggcggttctcaccaaccatgcctttggatttggtacagccattacaagaagggcaatgtacgattcgaattacactaagtttataaaagaccactttaactgggctgtgtttgaaaatgaatccaaatggtatacaaatgaacccagtatgggaattataacctatgacgatgctgactatttgtatgaattttgccggagcaacggaataaaagtgaggggacactgtattttctgggaggctgaagagtggcagcctgcatgggtaaggagtttggatccgtttaccctgcgttttgcggtagacaaccgcttaaacagtgctgtaggtcattttaaaggaaaattcgaacattgggatgtaaacaacgaaatgattcacggcaactttttcaagagccgtctgggtgagtccatctggccttatatgttcaacagggcaagagaaattgatccgaatgcaaagtattttgtaaacaacaatataaccactttgaaagaagcggatgattgtgtggccctggtaaactggctcagatcccagggagttcgtgtggacggcgtaggagtgcacggacactttggtgactcggtggaccgcaatcttctcaaaggaatacttgacaagctgtctgtcttgaaccttccgatatggattaccgaatatgattcggttacaccggatgaatacaggagggcggacaatctggagaacctctatcgtacggctttcagccatccttccgttgaaggaatcgtaatgtggggtttctgggaaagagtgcactggagaggaagagatgcgtcaatagtaaatgataactggacgttgaatgaagccggcagaaggtttgagtccttgatgaatgagtggactaccagggcttatggaagcacggatggttcgggcagctttggcttcagaggattctatggaacatacaggataaccgtgacagtgccgggaaaaggaaagtacaactatactttgaatctgaaccgcggcagcggaacattgcagactacttacagaattccc

SEQ ID NO: 195 - DNA, 1344 bp, Clostridium thermocellum
atgtcaaagataactttcccaaaagatttcatatggggttctgcaacagcagcatatcagattgaaggtgcatacaacgaagacggcaaaggtgaatctatatgggaccgtttttcccacacgccaggaaatatagcagacggacataccggcgatgttgcatgcgaccactatcatcgttatgaagaagatatcaaaataatgaaagaaatcggtattaaatcatacaggttttccatctcatggcccagaatctttcctgaaggaacaggtaaattaaatcaaaagggactggatttttacaaaaggctcacaaatctgcttctggaaaacggaattatgcctgcaatcactctttatcactgggaccttccccaaaagcttcaggataaaggcggatggaaaaaccgggacaccaccgattattttacagaatactctgaagtaatatttaaaaatctcggagatatcgttccaatatggtttactcacaatgaacccggtgttgtttctttgcttggccactttttaggaattcatgcccctgggataaaagacctccgcacttcattggaagtctcgcacaatcttcttttgtcccacggcaaggccgtgaaactgtttagagaaatgaatattgacgcccaaattggaatagctctcaatttatcttaccattatcccgcatccgaaaaagctgaggatattgaagcagcggaattgtcattttctctggcgggaaggtggtatctggatcctgtgctaaaaggccggtatcctgaaaacgcattgaaactttataaaaagaagggtattgagctttctttccctgaagatgacctgaaacttatcagtcagccaatagacttcatagcattcaacaattattcttcggaatttataaaatatgatccgtccagtgagtcaggtttttcacctgcaaactccatattagaaaagttcgaaaaaacagatatgggctggatcatatatcctgaaggcttgtatgatctgcttatgctccttgacagggattatggaaagccaaacattgttatcagcgaaaacggagccgccttcaaagatgaaataggtagcaacggaaagatagaagacacaaagagaatccaatatcttaaagattatctgacccaggctcacagggcaattcaggacggtgtaaacttaaaagcatactacttgtggtcgcttttggacaactttgaatgggcttacgggtacaacaagagattcggaatcgttcacgtaaattttgatacgttggaaagaaaaataaaggatagcggctactggtacaaagaagtaatcaaaaacaacggtttt

SEQ ID NO: 196 - DNA, 2262 bp, Clostridium thermocellum
atggcggtagatatcaagaaaataataaagcagatgactttggaagaaaaagcagggttgtgctcgggactggatttttggcataccaagcctgttgagagactgggcattccttcaataatgatgactgacggacctcatggactgagaaagcagagggaagatgcagagattgcggacatcaacaacagcgttccagcaacctgttttccgtctgcagcaggtttggcatgttcctgggacagagaactggttgagagagtaggtgcagcactaggagaagaatgtcaggcggaaaatgtctcaatactgcttggaccaggtgcaaatataaagcgttcacctttgtgtggaagaaattttgaatattttcccgaagacccttatctttcgtcagagctggcggcaagccatataaaaggagttcaaagtcagggagtgggtgcatgtcttaaacattttgccgcaaacaaccaggaacaccggagaatgaccgttgataccattgtagatgaaagaacgttgagggaaatatattttgcaagctttgagaatgctgtaaaaaaagcacggccttgggtggttatgtgtgcatataacaagctcaacggtgaatattgttcggagaacagatatcttttgacggaagttttaaagaatgaatggatgcatgacggctttgtggtatccgactggggtgcggtaaatgacagggtcagcggcctggatgcaggtcttgacctggaaatgcccaccagtcatggtattacggataaaaagatagttgaagccgtaaaaagcggaaagctgtctgaaaatattttaaacagagctgtggaaagaattttgaaagtaattattatggcactggaaaacaaaaaagaaaacgcgcagtatgaacaagatgctcatcacagactggcaaggcaggctgcggccgaatcgatggttcttcttaaaaacgaggacgatgtgcttcctttaaaaaagagcggaaccatagctttgataggagcttttgtgaaaaaaccaagataccagggttcgggcagttctcatattaccccgacaagacttgatgatatttatgaagagataaaaaaggccggagccgacaaagtaaaccttgtatattcggaaggatacaggcttgaaaatgacggtattgatgaggaattgataaacgaagctaaaaaggcggcatcaagctcggatgttgcggtagtatttgcagggcttccggatgaatatgaatctgaaggatttgacagaactcacatgagtattccggaaaatcaaaacaggctgatagaagcggtggccgaagtccagagtaatattgttgtggtattgcttaacggctcaccggttgaaatgccgtggattgacaaggtaaaatccgtgcttgaagcttatcttggaggccaggcgctgggaggccgctggcggatgtgctattcggtgaagtcaatcgtcggaaaacttgcggagaccttcccggtgaaattaagccataatccgtcctatttgaattttcccggagaggatgaccgagtggagtataaagaagggttgtttgtcggatacagatattatgatacaaagggaattgagccattgttcccctttggtcacggacttagctataccaaatttgaatacagtgatatatcagtcgataaaaaagatgtttcggacaatagcatcataaatgtcagcgttaaagtcaaaaatgttggaaaaatggcaggaaaagaaattgtgcagctgtatgtaaaagatgtgaaaagcagcgtcagaagacctgagaaagagcttaaaggatttgaaaaggtcttccttaatccgggagaagaaaagacggttacatttactttggacaaaagggcttttgcatattacaatactcagattaaggactggcatgttgaaagcggagagtttctgatattaataggaaggtcctccagggacatagttttaaaagaatcagtgagagtaaattcaacggtgaagataagaaaaagattcacagtgaattcagcggttgaagatgtaatgtccgattcttcggctgcggccgttttagggcctgtactaaaagagataaccgatgcactgcagattgatatggacaatgctcatgacatgatggcggccaatataaagaatatgcctttgcgctcacttgtcggttactctcagggaaggttaagcgaagaaatgctggaggaactggttgacaaaataaacaacgtggaa

SEQ ID NO: 197 - DNA, 1509 bp, Clostridium thermocellum
atgaaaaaagccagaatgaccgttgacaaagattataaaattgccgagatcgacaagcgtatctacggctcttttgtagaacatttgggaagggccgtatatgacggattgtatcagcctggaaattccaaatcggacgaagacggttttcgtaaagatgttattgaactggtgaaagaattgaatgtgccaattatccgttatccgggaggcaattttgtgtccaattatttctgggaagatggagtcgggccggtagaggataggcccagacgcttggatttggcttggaaaagtatagaacccaaccaggttgggattaatgaatttgcaaaatggtgcaaaaaagtaaatgctgagataatgatggcagtgaaccttggcaccagagggatttcggatgcatgtaatttgctggaatactgtaatcatccgggtggttcaaaatatagtgacatgagaataaaacatggagtaaaggaacctcacaacataaaggtttggtgtcttggcaatgaaatggacggtccgtggcaggtcgggcataaaacaatggatgagtacggccggattgctgaagagactgcaagggccatgaaaatgattgacccttcaattgagttggttgcctgcggaagttcctccaaagacatgcccacttttccccaatgggaagcaacagttctggattatgcttatgattatgtggattatatatcattgcatcagtattatgggaataaagaaaatgacacagctgattttttggcaaaatccgatgatttggatgattttatacgttctgtcattgccacttgtgattatataaaagcaaagaaaagaagcaagaaggatatatacctaagttttgatgaatggaatgtatggtatcactcaaataatgaagatgcaaacattatgcagaacgaaccatggagaatagcgcctcctttactggaggatatatatacgtttgaagatgcgttacttgtcggtttgatgctaattacccttatgaaacacgccgatagaataaaaattgcctgcctggcacagttgattaatgtaattgcgcctattgtgactgaaagaaatggcggggcggcttggaggcagaccatattttatccgtttatgcatgcttcaaaatatggcagaggaatagtacttcaaccggtgattaacagtccgcttcatgatacttcaaaacatgaagatgttaccgatattgaaagtgttgcaatttacaatgaagaaaaagaagaagtcacaatctttgcagttaacagaaatattcatgaggatattgttcttgtatcggatgtcaggggtatgaaagattatcgtctgctggagcatattgtcttggagcatcaagatctaaaaatccgtaatagtgtaaatggtgaggaggtatatccgaaaaattcggataaatcctcatttgatgatggtattttaacgagtatgcttcgcagagcctcttggaatgtaattcggataggtaaa

SEQ ID NO: 198 - DNA, 1443 bp, Clostridium thermocellum
atgaaacacaaaggcattgtattaaagctgacaaaaagcaaagccataataagtaccaatgattttcaatgctactatatcaaaagaagccctacaatttatgtaggaaaggaagttgaatttacaaataaagatattgtgacaaagaagtctgttttaataaaaccggctttaagcgttgcctgttttatattgttgatagcttgtgttttaagcctttcaaaaataatcaataatattagccctaaagtttttgcctatatcagcgttgatataaatcccagctttgaaattgaaatcgatgacatgggaaatgttttgaatttgcttccgttaaatgatgatgcaaaggttattgccgataaattggaaattgataaaatcaacgtttccaatgccattgatattataataaatgaagcaataaaaagcaatgttataaatgaaaatgaaaaggactttatattagtttcaagcaccctgaatattaaaaaagaggagaacagccaacagtatcagagtgaaaaagaaaaacttgatattatcataaattccctgaaagacagcatagaaaaaagcggaaaagcggatgtttacattgtccaggctgacgtgaatgaaagggaagccgcacgaagtaaaggaatatctacaggaagatacgttttatataacaagtataaagatctggaaaacgatctgtctttggaagatgccaaagatgctgatgtcaatgtgttaataaaaagtatgttggatgtggcatcagaagaaagaaatccggaagaatcaccaaaaatgaccccaactccaacaccgacacatacagcaacacatacaccgacagatgcaccaacgccgaaaccggcaaatacaccaacatcaacaccggcagcaaaaccttcaccaaaaacggcatcgaactcagcctcgacatcaacacctgccccgaaacctacatcaacaccgacaccaacattgatgccaacacctactccaacaccgacacctgctgataaaatcgcatatggtcagtttatgaaatttgaatccagcaactaccgcggatattatatacgggttaaatcgttttccggccgtatcgacccatatgtgaatcctgtggaagattccatgttcaagatagttcccggtcttgcagacccaagctgtatttctttcgagtcgaagacttatccgggatattacctcaaacatgaaaacttcagagttattcttaaaaaatatgaagataccgatttattcagagaagatgcaactttcagagttgtaccgggttgggcggatgaaaacatgatttctttccagtcatataattatccttacagatatatcaggcacagggattttgagctttacatagaaaacataaaaaccgatcttgacagaaaggatgcaacatttatagggattaaagttgat

SEQ ID NO: 199 - DNA, 2661 bp, Clostridium thermocellum
atgaggctggttaacagtttgggaagaagaaaaattcttttgatacttgctgttattgtagctttcagcactgttctgttgtttgcaaagctatgggggcgaaagacttcaagtactttggatgaggttggttcaaaaactcatggtgatttgacggcagaaaataaaaacggcggatatttaccagaggaagagattccagatcagcctccggcaaccggggccttcaactacggtgaagcgttgcaaaaagcaatttttttctatgagtgtcaaagatccggaaagctcgatccctcaactcttcgcctaaattggcggggagattcgggactggatgacggaaaagatgcaggaattgatcttaccggcggatggtatgatgcgggagatcacgtaaaatttaatttgcccatgtcttattcggcggctatgctggggtgggcggtgtatgaatatgaagatgcgtttaaacagagtggacagtataaccacatattgaataacataaaatgggcttgtgattattttataaaatgtcatccggaaaaggatgtgtactattaccaggtgggcgacggtcatgctgaccatgcgtggtggggtcctgccgaagtaatgcctatggaaaggccgtcgtacaaagttgacaggtcatcgccgggttccacggttgtggcagagacgtcggcagctttagctatagcatcgataatatttaagaaagtggatggtgaatactcgaaagaatgtttaaagcatgcaaaagaactgtttgaatttgcggacaccacaaaaagcgatgatgggtacactgcagccaatggtttttataattcatggagcggattttatgatgagctttcctgggcagctgtatggctttatcttgctaccaatgattcttcatatttggataaagcggaaagttattctgacaaatggggttatgagccacagacgaacataccgaagtataagtgggctcaatgctgggatgatgtgacttatggcacttatcttcttttggccaggattaaaaatgacaacggaaaatataaagaagcgatagaaaggcatcttgattggtggacaaccggatacaacggtgaaagaattacatatactccgaagggacttgcatggctcgaccagtggggatcattgaggtatgcaaccacaacggcatttctggcatgtgtttattccgattgggagaacggtgataaggaaaaagcaaaaacttatctggagtttgcaagaagccaggcggattatgctttgggaagcacgggaagaagctttgttgtgggttttggagaaaatccaccgaaaaggccccatcacagaactgctcacggttcatgggcggacagtcagatggagcctcccgaacacaggcatgttctttatggtgcccttgtgggaggacctgacagcacggacaactacaccgacgacatcagtaattacacctgcaatgaagttgcctgtgactataatgcaggttttgtgggactgcttgcaaaaatgtacaagctttatggcggaagtcccgatcccaaatttaacggtatagaagaagttccggaggatgaaatattcgttgaagccggtgtgaatgcatcgggaaacaatttcattgaaataaaagcgatagttaataataaatcgggctggcctgcaagagtatgtgagaatttatcctttagatattttatcaacattgaagagattgtgaatgcgggaaaaagtgcaagcgacctgcaagtgagctccagctacaatcagggggcaaaactgtccgatgtaaagcactacaaggacaatatttattatgtggaagtggatttgtcggggacaaaaatatatcccgggggacaatcggcatacaagaaggaagtgcagtttagaatttccgcgccggagggcacggtgtttaatccggaaaacgactattcctatcagggactttcggcaggtacggttgtaaagtctgagtatattccggtatatgatgccggggtgctggtatttggaagggaaccgggctcagcatcgaaaagcacgtctaaagacaatggtttgtccaaggcaactcccacggtgaaaactgaatctcagccgacagcaaaacacactcaaaatcctgcctcagactttaaaactccagccaatcagaacagtgtaaaaaaagaccaaggcataaaaggagaagtggtattacagtacgcaaacgggaatgcaggtgctacgtcaaacagtattaatccgaggtttaaaataattaacaacggtacaaaagccataaatttgtccgatgtcaagattagatattattacacaaaagaagggggcgcatctcaaaacttctggtgtgattggagcagtgccggcaattcaaatgttacaggaaacttctttaatctttcttcaccgaaagaaggagcggacacctgtcttgaagttggtttcggaagtggggccggaacccttgatcctggtggaagcgttgaagtacagataaggttttcaaaggaagactggtcaaactataaccagtcaaacgattattctttcaatccgtctgcttccgattatacggattggaacagggtgacgttgtatatttcaaacaagcttgtttacggcaaagaacct

SEQ ID NO: 200 - DNA, 2685 bp, Clostridium thermocellum
atgaatttcagaagaatgttgtgcgcagccatagtgttgacaattgtactgtccattatgctgccgtcaactgtttttgctttggaagacaagtctccaaagttgccggattataaaaacgaccttttgtatgaaagaacattcgacgaaggtctttgctttccgtggcatacttgcgaagacagtggaggaaaatgtgatttcgctgttgttgatgttccaggagagcctgggaacaaagctttccgcttgacagtaattgacaaaggacaaaacaagtggagtgtccagatgagacacagaggtattaccctcgagcaaggacatacatacacggtaaggtttacgatttggtctgacaaatcctgtagggtttatgctaaaattggtcagatgggtgaaccctatactgaatattggaacaataactggaatccattcaaccttacaccaggacagaagcttacagttgaacagaattttacaatgaactatcctactgatgacacatgcgagttcacattccatttgggtggagaacttgctgcaggtacaccttactatgtttaccttgatgatgtatctctctacgatcctaggtttgtaaagcctgttgaatatgtacttccgcagccggatgtacgtgttaaccaggtaggatacttaccgtttgcaaagaagtatgctactgttgtatcttcttcaaccagcccgcttaagtggcagcttctcaattcggcaaatcaggttgttttggaaggtaatacaataccaaaaggacttgacaaagattcacaggattatgtacattggatagatttctccaactttaagactgaaggaaaaggttattacttcaagcttccgactgtaaacagcgatacaaattacagccatcctttcgatatcagtgctgatatttactccaagatgaaatttgatgcattggcattcttctatcacaagagaagcggtattcctattgaaatgccgtatgcaggaggagaacagtggaccagacctgcaggacatattggtgttgctccgaacaaaggagacacaaatgttcctacatggcctcaggatgatgaatatgcaggaagacctcaaaaatattatacaaaagatgtaaccggtggatggtatgatgccggtgaccacggtaaatatgttgtaaacggcggtatagctgtttggacattgatgaacatgtatgaaagggcaaaaatcagaggcatagctaatcaaggtgcttataaagacggtggaatgaacataccggagagaaataacggttatccggacattcttgatgaagcaagatgggaaattgagttctttaagaaaatgcaggtaactgaaaaagaggatccttccatagccggaatggtacaccacaaaattcacgacttcagatggactgctttgggtatgttgcctcacgaagatccccagccacgttacttaaggccggtaagtacggctgcgactttgaactttgcggcaactttggcacaaagtgcacgtctttggaaagattatgatccgacttttgctgctgactgtttggaaaaggctgaaatagcatggcaggcggcattaaagcatcctgatatttatgctgagtatactcccggtagcggtggtcccggaggcggaccatacaatgacgactatgtcggagacgaattctactgggcagcctgcgaactttatgtaacaacaggaaaagacgaatataagaattacctgatgaattcacctcactatcttgaaatgcctgcaaagatgggtgaaaacggtggagcaaacggagaagacaacggattgtggggatgcttcacctggggaactactcaaggattgggaactattactcttgcattagttgaaaacggattgccgtctgcagacattcaaaaggcaagaaacaatatagctaaagctgcagacaaatggcttgagaatattgaagagcaaggttacagactgccgatcaaacaggcggaggatgagagaggcggttatccatggggttcaaactccttcattttgaaccagatgatagttatgggatacgcatatgactttacaggcaacagcaagtatcttgacggaatgcaggatggtatgagctacctgttgggaagaaacggactggatcagtcctatgtaacagggtatggtgagcgtccacttcagaatcctcatgacagattctggacgccacagacaagtaagaaattccctgctccacctccgggtataattgccggtggtccgaactcccgtttcgaagacccgacaataactgcagcagttaagaaggatacaccgccgcagaagtgctacattgaccatacagactcatggtcaaccaacgagataactattaactggaatgctccgtttgcatgggttacagcttatctcgatgaaattgacttaataacaccgccaggaggagtagacccagaagaaccggaggttatttatggtgactgcaatggcgacggaaaagttaattcaactgacgctgtggcattgaagagatatatcttgagatcaggtataagcatcaacactgataatgctgatgtaaatgctgatggcagagttaactctacagacttggcaatattgaagagatatattcttaaagagatagatgtattgccacataaa

SEQ ID NO: 201 - DNA, 1947 bp, Clostridium thermocellum
atgagtagaatgaccttgaaaagcagcatgaaaaaacgtgtgttatctttgctcattgctgtagtgtttctaagcttgaccggagtatttccttcgggattgattgagaccaaagtgtcagctgcaaaaataacggagaattatcaatttgattcacgaatccgtttaaactcaataggttttataccgaaccacagcaaaaaggcgactatagctgcaaattgttcaaccttttatgttgttaaagaagacggaacaatagtgtataccggaacggcaacttcaatgtttgacaatgatacaaaagaaactgtttatattgctgatttttcatctgttaatgaagaaggaacgtactatcttgccgtgccgggagtaggaaaaagcgtaaactttaaaattgcaatgaatgtatatgaggatgcttttaaaacagcaatgctgggaatgtatttgctgcgctgcggcaccagtgtgtcggccacatacaacggaatacactattcccatggaccgtgccatactaatgatgcatatcttgattatataaacggacagcatactaaaaaagacagtacaaaaggctggcatgatgcgggcgactacaacaaatatgtggtaaacgccggcataaccgttggttcaatgttcctggcgtgggagcattttaaagaccagttggagcctgtggcattggagattcccgaaaagaacaattcaataccggattttcttgatgaattaaaatatgagatagactggattcttaccatgcaataccctgacgggagcggaagggtggctcataaagtttcgacaaggaactttggcggctttatcatgcctgagaacgaacacgacgaaagatttttcgtgccctggagcagtgccgcaacggcagactttgttgccatgacggccatggctgcaagaatattcaggccttatgatcctcaatatgctgaaaaatgtataaatgcggcaaaagtaagctatgagtttttgaagaacaatcctgcgaatgtttttgcaaaccagagtggattctcaacaggagaatatgccactgtcagtgatgcagatgacagattgtgggcggcggctgaaatgtgggagaccctgggagatgaagaataccttagagattttgaaaacagggcggcgcaattctcgaaaaaaatagaagccgattttgactgggataatgttgcaaacttaggtatgtttacatatcttttgtcagaaagaccgggcaagaatcctgctttggtgcagtcaataaaggatagtctcctttccactgcggattcaattgtgaggaccagccaaaaccatggctatggcagaacccttggtacaacatattactggggatgcaacggcacggttgtaagacagactatgatacttcaggttgcgaacaagatttcacccaacaatgattatgtaaatgctgctctcgatgcgatttcacatgtatttggaagaaactattacaacaggtcttatgtaacaggccttggtataaatcctcctatgaatcctcatgacagacgttcaggggctgacggaatatgggagccgtggcccggttaccttgtaggaggaggatggcccggaccgaaggattgggtggatattcaggacagttatcagaccaatgaaattgctataaactggaatgcggcattgatttatgcccttgccggatttgtcaactataattctgctcaaaatgaagtactgtacggagatgtgaatgatgacggaaaagtaaactccactgacttgactttgttaaaaagatatgttcttaaagccgtctcaactctgccttcttccaaagctgaaaagaacgcagatgtaaatcgtgacggaagagttaattccagtgatgtcacaatactttcaagatatttgataagggtaatcgagaaattaccaata

SEQ ID NO: 202 - DNA, 1965 bp, Clostridium stercorarium
atgaagcgtaaggttaagaagatggcagctatggcaacgagtataattatggctatcatgatcatcctacatagtataccagtactcgccgggcgaataatttacgacaatgagacaggcacacatggaggctacgactatgagctctggaaagactacggaaatacgattatggaacttaacgacggtggtacttttagttgtcaatggagtaatatcggtaatgcactatttagaaaagggagaaaatttaattccgacaaaacctatcaagaattaggagatatagtagttgaatatggctgtgattacaatccaaacggaaattcctatttgtgtgtttacggttggacaagaaatccactggttgaatattacattgtagaaagctggggcagctggcgtccacctggagcaacacccaaaggaaccatcacagtggatggcggtacttatgaaatatatgaaactacccgggtaaatcagccttccatcgatggaactgcgacattccaacaatattggagtgttcgtacatccaagagaacaagcggaacaatatctgtcactgaacattttaaacagtgggaaagaatgggcatgcgaatgggtaagatgtatgaagttgctcttaccgttgaaggttatcagagcagtgggtacgctaatgtatacaagaatgaaatcagaataggtgcaaatccaactcctgccccatctcaaagcccaattagaagagatgcattttcaataatcgaagcggaagaatataacagcacaaattcctccactttacaagtgattggaacgccaaataatggcagaggaattggttatattgaaaatggtaataccgtaacttacagcaatatagattttggtagtggtgcaacagggttctctgcaactgttgcaacggaggttaatacctcaattcaaatccgttctgacagtcctaccggaactctacttggtaccttatatgtaagttctaccggcagctggaatacatatcaaaccgtatctacaaacatcagcaaaattaccggcgttcatgatattgtattggtattctcaggtccagtcaatgtggacaacttcatatttagcagaagttcaccagtgcctgcacctggtgataacacaagagacgcatattctatcattcaggccgaggattatgacagcagttatggccccaaccttcaaatctttagcttaccaggcggtggcagcgccattggctatattgaaaatggttattccactacctataataacgttaatttcgccaacggcttaagttctataacagcaagagttgccactcagatctcaacttccattcaggtgagagcaggaggagcaaccggtactttacttggtacaatatatgttccttcgacaaatagttgggattcttatcagaatgtaactgccaaccttagcaatattacaggtgtgcatgatattacccttgtcttttcaggaccagtgaatgtggactacttcgtatttacaccagcaaatgtaaattcagggcctacctcccctgtcggaggtacaagaagtgcattttccaatattcaagccgaagattatgacagcagttatggtcccaaccttcaaatctttagcttaccaggtggtggcagcgccattggctatattgaaaatggttattccactacctataaaaatattgattttggtgacggcgcaacgtccgtaacagcaagagtagctacccagaatgctactaccattcaggtaagattgggaagtccatcgggtacattacttggaacaatttacgtggggtccacaggaagctttgatacttatagggatgtatccgctaccattagtaatactgcgggtgtaaaagatattgttcttgtattctcaggtcctgttaatgttgactggtttgtattctcaaaattcaggaacttaagggtatag

SEQ ID NO: 203 - DNA, 1164 bp, Clostridium stercorarium
atgaataaattcttaaacaaaaaatggagcttaattttaaccatgggaggtatttttctgatggcgactttatcattgatttttgcaacggggaaaaaggcctttaacgatcaaacttctgctgaagacatcccatcgcttgctgaggctttcagagactattttccgattggagcggccattgagcctgggtataccacaggccaaatagccgaactgtataagaaacacgtgaacatgctcgtggcggaaaatgcaatgaaaccggcgtcacttcagccgacggaaggtaattttcagtgggcagacgctgacagaattgtgcagtttgcgaaagaaaacggtatggaactgcgcttccacactcttgtgtggcataatcagacgccgactggtttttccttggataaagaaggaaaaccaatggtggaggagactgatccacagaagcgtgaagaaaacaggaaacttctgctgcaacggcttgagaattatattcgtgctgtggttttacgctacaaagacgacataaagtcatgggatgtggtgaatgaggtaattgaacccaatgatcccggcggtatgagaaacagtccttggtatcagattaccggtaccgagtacatcgaagtggcattccgtgcggcaagggaagcgggaggatccgatattaagctttatatcaacgattacaatacagatgaccctgtcaagagagatatactgtatgaattagtgaaaaatttgctggagaagggtgtgccgattgacggggtgggacatcagacacatattgatatttacaatccgcctgtcgagcgaataatagagtctataaaaaaatttgccggactgggactggacaacataattaccgaactggacatgagcatatattcatggaatgaccgcagcgattacggcgatagtatacccgattatatcctgactttacaggccaaacgttatcaggaactgtttgatgcgttaaaggaaaataaggacattgtaagcgcagtggtgttttggggcatttcggacaaatattcctggttgaacgggtttcctgtaaaacgtaccaatgccccgctgctgttcgacagaaatttcatgccgaaaccagctttctgggcgatagttgatccttcacggttgcgggaataa

SEQ ID NO: 204 - DNA, 3099 bp, Clostridium stercorarium
atgaatggccgtaatgggggtaaaagacctatagcgagcctgcttgtgctcacacttgcatttttattcattccggtaacgaaggcagaaacaacggtttatcatgagacttttgccgaaggaaagggagcggcggtacagtcaggcggggcgaccattacgcacgttaccggaaaattttttgacggcaacggggacggagcggcactgtacatatccaacagagtgaacaactgggacgctgcagatttcagattcagcgacataggtcttcaggacggaagaatttataaaataacggtaaagggatatgtggatcccgatgttcatgtaccggagggttcccagatatggcttcagaccgttaacagctatgggtggtggggcagtaccgacataaaggccggtgaagcctttactctgacgggcgtatataaggtggatacaaccaatgattatgctctgaggattcagtccaatgacaccggagcatttgttccgttttatatcggtgaaatattgatcaccgaagaaacggttcctcaggatgacagccgaaatgggaataaaactcatgctgagaagttcacacccataacctttgaggaccaaaccacaggcggatttacaggcagggcaggaaccgaaattcttacggtaaccgatgaggcaaaccataccgatggcggaagatattcgcttaaagtcgggggaaggaacgacacatggcatggcccggcgttgggtgtggaaaaatacgtggatcagggttacgaatataaagtggcggtttatgtcaggctgatttcacctgaaagtgcacaactgcaactgtcaacgcaaattggtgaaggcacatcggcaagttacgtaaaccttgcgaaaaagaatgttgcaatcagtgacggctgggttctgctggaaggtacataccgctacgacaatcttggcggagggtacctgacaatatatgtggagagccctgacagccctgaggcatcattttatattgacgacatcaactttgaacccacgggcatgaaatctgaagagattgaaaaaggtttaaaatccttgaaggatgtgtataaggataattttctcaccggcacggcgatatcattgcgtgacctggaaggtgtaaggtttgagcttctgaaaaaacatttcaatgcggtaactgcggaaaatgcaatgaagccttccgaattgcagcgtgagaagggaaattttacctttgacggggcagacaggcttgtaaacgccgcaataagtgcaggaatgaaagtacacgggcatacgctggtatggcaccagcagacccccgcgtggatgaatattaagttggatagcggaggaaatattgtatacctcagcagggaagaagcgcttgaaaatatgagaaatcatataagaaccgttattgagcattttggcgacaaggttatatcgtgggatgttgtaaacgaagcaatgagcgacaatccttccaatccttccgactggagaggatcactgcgtaaatcgccttggtattatgccattggcgaagactacgtggaacaggctttccttgccgcgagagaggtgctggatgaacaccccgaatgggatattaagctttactacaacgattacaaccttgataaccagaacaaagctttggctgtttacaacatggtaagagaacttaacgaaaaataccagaaaactcatccgggaaaactccttatcgacggtataggcatgcagggacattattctgtaaatacaaatccgaagaatgttgaactgtcactgaagcggtttaccgaactgggtgtggaggtcagcataagcgaactggatatccgtgcgggcagcaattatcagctcaccgagaaagaggcgaatgcccaggcctacctttacgctcagttgttcaaaattttccgtgaatattccgacagtattgcacgggttacgttctggggaatggatgacggtacaagctggagggcggaagaaagcccgctgctgtttgacaggaccctaaaagccaaacctgcgtattacgctgttgcagatccggacgaattcattgagaaatataagcctgaaacaatagaagccaaccgggcatatgcggtttacggcacacctgaaattgacggaaaaaccgatgaagtttggaacaaggcacctgagctgaaaattaacaggtaccagaccgcttggcatggcgccgacggcaccgcaagggttctttacgacgaaaacaacctgtacgttctgatcaaggttaatgacacacagcttgataaaggaagcccaaatccatgggagcaggattcggttgaaatatttatagacgaaaataatgcaaaaacatcattttatgaggaagacgacggccagtacagggttaactttgaaaacgagacatcctttaatccggaaagtatagccggcggttttgaatcggccgcggaagtttcgggaacaaactataccttggaagtgaaaataccgttcaggaccgtgaaacccgtcagcaatatgcaaatcggatttgacgtgcagattaacgacggaaaaaacggagtgcggcagagcattgcaacatggaatgacccgactggaaatgcatggcaggatacttcggttttcggtattcttactttgaaatcaaaaaatccggttacccgcggtgaagccattgtaaaaattatgaaggcttatgatatggaaccactggaaaactggaacgacaatttctccgatgcttcgggaagctacgcgggatattacccgagagcaaaggaaacgggttttgtcagcggtatcggggacaataagataggtgctgaaattccgcttacccgggaaatgttttttacaatgatttataatatcgaacgaataacagggaaaatgcaggggatagatatttcagacgcggaacttacacttttcagcgattataacgacttgtcggagtgggccgaagaggcagttaaggcattggttaaatcaggcaggatcaaaattaacggcgatttattgccgaagcggcttatggacgctgaagaagtggaggcatttttaagattaagataa

SEQ ID NO: 205 - DNA, 2148 bp, Clostridium stercorarium
atggaaaacaaacctgtttatctggatccgagttattcgtttgaagaacgcgcaaaagatcttgtgtcaaggatgaccattgaggaaaaggtatctcagatgctttacaattcacctgcaatcgaaaggctcggaattcctgcatataactggtggaacgaagcacttcacggtgtggcgcgggccggaacggcgaccatgttcccgcaggctatcggaatggcggctacgtttgacgaagagcttatttataaagtggcggatgttatttcaacagagggcagggcaaaataccatgcaagcagtaaaaaaggcgatcgcgggatatataagggtttaacattctggtcccctaatatcaacatattcagggatccaagatggggacgcggccaggaaacctacggggaggatccttacctcacggcaaggctcggtgttgcctttgtaaaaggcctgcagggaaaccatccgaaataccttaaggctggcggcatgtgcaaaaacattttgccgttcacagtggtccccgaatccttaaggcatgaatttaatgccgtagtgtccaaaaaggatctgtatgagacctatctgccggcttttaaggctttggttcaggaagcaaaagttgaatcggtgatgggagcgtataaccgtacaaacggtgaaccctgctgcggcagtaagacccttctttccgatattctcagaggggaatggggatttaagggacatgtggtatccgactgctgggcaatacgcgatttccatatgcaccatcatgttacggcaacagctcccgaatcagccgcccttgcagtacgcaatggctgcgatctgaactgcggaaacatgttcggaaacctgttaatagcccttaaggaaggcttgatcactgaagaggagatagacagagccgtaacaaggcttatgattacaagaatgaaactgggaatgttcgatcctgaagatcaggtgccttatgcatcgatttcgtccttcgtcgattgcaaggaacacagagagctcgcgctggacgtggcgaaaaaatccattgtcctgctaaagaatgacggcctgttgccgcttgacaggaagaaaatcaggtccatcgccgttataggcccgaatgccgacagccgccaggctctgattggaaactacgaaggaacggcgtcggaatatgtaaccgttcttgacggaatcagggaaatggcaggggacgatgtaaggatttactattcagtcggctgtcatttatacaaggacagagttgagaacctcggcgaacccggggacagaatcgcggaggcagttacctgtgccgaacacgccgacgtggttatcatgtgccttggccttgattcaaccattgaaggcgaagaaatgcatgaaagtaatatatacggttcgggcgacaagcctgatcttaaccttccggggcagcagcaggaactgctggaggctgtttacgccaccggtaagccgattgttcttgtactgcttacaggaagtgctctggcagtaacgtgggccgatgagcatatcccggcaatactgaacgcatggtatccgggggcgctgggaggaagggcaattgcctcggtactgttcggtgaaaccaacccgtcagggaagctgccggttacattctatcgtaccaccgaagaacttcccgactttacagattactcaatggaaaacagaacctacaggtttatgaagaatgaagcgctgtacccgtttggatttggtttgagctatacgacgtttgactacagcgatctgaagctgtcgaaggatacaatcagggcaggggaaggctttaacgtttcggtaaaggtaacgaataccgggaaaatggccggtgaagaagtggtccaggtttacatcaaggatttggaagcaagctggagagttcccaactggcagctttcgggaatgaagagagtaaggcttgaaagcggtgaaactgctgaaattacttttgaaatacggcctgaacagctggctgttgttaccgatgagggaaaaagcgttatcgagccgggtgagtttgaaatttatgtcggcggctcgcagccggatgcaagaagcgtcaggcttatgggaaaagcgccgctgaaagccgtgctgcgcgtgcagtaa

SEQ ID NO: 206 - DNA, 1503 bp, Clostridium stercorarium
atggcaagggaaatcacaataccggctgccggtaagccttttaaaaacaacgccaccttctgcgtgggaagcggaagattaggactggcactgcagaaggaatacatagaccatttgaaaattgtccaggaacgcatccattttaaatatatccgcgggcacgggctgttctgcgatgatgtgggaatataccgcgaaaccgaagaggacgggaagcacgtcgcctactataattttacataccttgaccgcattatagattcttttcttgaacacgatataagaccgtttcttgaattgggatttatgcctgaaaagctgaaatccggggaacagacaatattctactggaaaggaaataccacgccccctgtttcgtatgaaaaatgggccgaacttgtggaaactacgttagcccatcttatcgacaggtatggagcggaagaggttataacatggccggttgaagtctggaatgaacccaatatagctttttgggcgggaacaatggaagagtatttcaaactgtatgagtattccgcaaagcgtgaaagggttgatccgaataaagtcggcgggccggtgatatgtggtatagaaaccgaaaaatggctgcgtgccttttttgagcattgcatagaaaataatttgcctctggatttcgtaagccggcattgttatactgtgggaaagccggtgcgcaaggggcagtttatttatcatgaaatattcagtccaacgtatatgatagaggaattaaaggaaacaagaaaaataatggccgattatccgcagattgctaatctgccgctgcatataaccgaatttaacagttcttacgttcctgtatgcccggtgcatgacacaactttccaggctgcatatattgcgaggattctcagtgaggccggtgaatatgccgattcctattcttactggacattcagtgatgtttttgaggaatatgacgttccaagatcggcgtttcacggaggttttggccttgtggcgctgaattcaattaaaaaaccggtatttcatacttttgaattttttgccaatgcgggcaaggaactgctttaccgcgatgagaatctgattgttacaagggatgacaaaagatatgttataataggctggaactaccatgacacaagaaagggtgagccgggcccggataaagagtatgtactctcaattccctccatcgggcagcaggcaatactgattaaaaagcaggtgggagggaattatgccaatccgctgcagacatggagcaatctgggaaagccacggacgctgaataaggaacaaagaaaaatactgatggcggcgtctgaaccgcttcagacagatgtgaaactgtttgacgaaaagggtttttataaagtgaaactgaccattcagtgcaatcatctgtatatgctggaaattctgcctgttaaggattttaccgatacatatgacggttttgaaccggatgaattttttggacttgaataa

SEQ ID NO: 207 - DNA, 2265 bp, Clostridium stercorarium
atgcaaagggacatcaaaaaaattatttcacaaatgacgctggaagaaaaggcgagcttatgctcggccttggacgcctggaccttaaaaggcgtagaacgtttgggcattccgtccattatggtatctgacggcccccatggtctcagaaagagacaacgggatcccactgatcccggtaagaaaaccactgtcccggccacatgtttccccactgcggtgggccttgcaagctcatggaaccgtgaactggtggagaaagtaggccccgcattgggggaagaatgccaggctgaaggaatagcagtgcttcttggcccgggaaccaatataaaactttcccctctttccggaagaaactttgaatatttttcggaagacccgtacctttcttcggagatggccagaagccatataaaaggagtgcagagccggggagtggggacgtccctgaagcattttgcggcaaataaccaggaacaccgcagaatgagcgtggatgcggtaattgacgaaagaacgctgcgtgaaatttacctcgccagtttcgaaggggcggttaaaaaggcgaagccgtggacgatcatgtgttcatacaacagggtaaacggcgagtatgcatctgaaaataaatttctgttaacagatgtactgagaaatgaatggggttttgaaggcattgtggtatccgactggggagcggtgaatgagagggtaaagggactggaagccggacttgatcttgaaatgccgtcaagcttcggtattggcgaccaaaaaatagttgaagccgtaaagaagggtgagctgcccgaagaggtattggacagaaccgttgaaaggatacttaatttaatttttaaagcggtggataacaggaaagaaaatgccggatatgaccgggaagctcatcacaaactggccagagaagcggcaagggagtgcatggtgctgcttaagaacgaggacaaaatacttccgcttaggaagcagggaaccatagccgtaataggcgaatttgctaaaagaccacggtatcagggcggaggaagctcccatgtaaatccaacaatcatggatagtccatatgaagaaatcaaaaaatcagcgggaaacaatgcagatgttatatatgcgcaaggttatattattgaaaaggacgagccagatgaaaaactcctggaggaagcaaagcagacggcgctgaaggcagatgtcgccgtgatatttgcagggcttcccgagcattatgaatgcgagggctatgaccgtacgcatatgagaatgcccgaaagccactgcacgcttatcgaagaagtggcggaagtaacaaccaatgtggtggtggtattatgcaacggttcaccggtggagatgccatggattgacaaagtgaagggattgctggaggcttacctgggcggacaagccatgggcgggccattgccgatcttctgttcggagacgccaatcccagggaagctcgccgagactttcccgaaacagttaagcgataacccttcatatttgaatttccgggaacgggacagggttgaatacagggaaggcatattcgtgggctacaggtattatgacaaaaagaatatggaaccgctgttcccgttcggatacgggctcagctacactacgtttgagtacggcgatctgaaaataagcaggaaagaaatatctgataacgaaacggtgactgtgagcgtaaaggttaagaataccggagatatggcgggtaaggagattgtgcagctttacgtaagggatattgaaacctcggtaatagaccggagaaggactgaagggtttgaaaaagttgaacttcagcccggcgaggaaaaaacggtggtgtttgaacttgacaagagggcgtttgcttatacacaccggtataaggactggcatgttgaaaccggtgaatttcgagattttataggcagatcctcaagggacatagtgcttaaagacaagatattcgtcaaatcaaccgttaccataaaaaaacggtggacagtaaacacgctggtgggggatttgctttctgatcgggttcttgagcctgtattcagagagtttattattaacgagataaaaacatggtacttgttggatttactggacgaggataatcacctcctgagtgtgtggatgaggtatactcctctgcgttcattggcgaacagtacgggtggggaactgaacgaggaaaagctgaacaggctgattgatacactgaatgcaaatattaaataa

SEQ ID NO: 208 - DNA, 1464 bp, Clostridium stercorarium
atgtcaactaccaccgatccgtataaaggctgggcacctctgacccatgtcaaaaagacaagaggttggattgatccatgcccgttctgggatgaccacgggaatgcgtatcttgtaagggtttcggaaaaagcaggattgggttcaagagatcctgcatctgtcccgggtgagtctgacggtacctgtcttctcgatgagggagttcatatatttgacggcaatctgaaccatcacaccattgaaggggccaaaatgtataaaagaaacggctattattacatttttgctcctgcaggaggggtaaaaacaggatggcagacggttttacgctccaaaaatatatacggaccgtatgaggacagaatagtaatgcatcagggaaaaaccaatgtaaacggccctcaccaaggcggttgggttgaaactcaaacaggagaacactggttcatacattttcaggacagagggccttacggaaggattgtgcatctgcagcctatggtatgggttgacgactggccggttataggtaaggacaccgaaaactgcggtacgggtgaacccgtggacgtatataaaaagcctgacgtgggaggagtatttcctgttcaggttcctgagacctccgatgattttgacaaaaataagcttggccttcagtggcagtggaatgccaaccctcaggaaaaatggtactcactgaccgaaagagatggctttttacgcctttatgcactgaataattccaatgaaagcggacttctgtaccatgctcctaatatactgacccagctgtttcaggcaccggagttcaccgcttccgcaaagcttgaattttcacctgcacaaaccggagacaaagccggtttggtgatactcggggatgaatacatgtatctgacgatagaaaaaacggaagaagccaacaaagttgcctgcatttatggttcaccctccgaaaacggctacagagaagaggttttggaatcccgtactgctgaaagtaccacggtaatattccgggttgatgtacggaatggggcggtatgctcattcagcttcagttatgaccgtgaaaattttgttaacgcaggcagggattttaacgcaaccgcaggcagctgggtgggtgcgaaactgggtatatttgcgatgaatacatattccgacagtaaaggtttcgctgatttcgactgggtgattgtaggaaagccggtagtaccggcagaggataatattgtttcgagaggtgatattatgaagaaatacgacaataattacggggtaagaatgtgtgattcggttataaaaaggcacagactgcttccggttaaatggtcatatgactacggagtgtatttgagggtatggaaaaaatctggcttaaaacaggcgatgaaaaatatttcaggtacattaaggacaatatggatatttacgtggattcccacggatatatag

SEQ ID NO: 209 - DNA, 1476 bp, Clostridium stercorarium
atggccaaatacgtaatcaacaccctgaacaggaagagcaaaattaacagggaaatctacggtcacttctcggaacaccttggcaggtgcatatacggcggtttttatgttggtgaaaattcccccattccgaacaccaaaggcatcagaaatgacgtggttaacgctctgaaaaagataagaattccggtacttcgctggccgggcggttgttttgccgatgaataccactggatggacggaattggcccgaaagaacagaggaaaaaaatgatcaatacccactggggcggagttgtcgaagcaagttttgggaccgacgagttcatggaactttgccgccagctggaatgcgagccttatattaacggcaatctgggaagcggtactgtaaaggaaatgcaggactggattgagtatctgacatttgacggcatatccccaatgtctgaattaagggcaaaaaacggaagaaaagaaccttacaggttgaaatatttctgcataggcaacgaaaactggggctgcggcggaaacatgagacctgagttctatgccgacatgtacagaagataccagacttacgtaagaaactacgggaataacaagatatacaaaatcgcctgcgggccgaacagcgatgattacaactggacagaaacggttgttaaaattgcgggcagattcatggacgccatctcgctgcattattacacagtgccgggaacctggcattcgaagggcagttccacgaaattcaccgaagaagaatggtatataaccctgtttaaaactctcaaaatggatgagctgatcactaaacataccgcgataataagaagatacgaccccgacaaccgcatagggctggttgtggatgaatggggtacatggtatgacgttgagcccggaacaaatcccggattcctgtaccagcaaaatacaatgagagacgcgcttgttgcggggattaaccttaacatctttaacaaacacagcgacaaagttgtaatggcaaacctcgctcaaaccattaacgttcttcaggcagtgatccttaccgaaggcgaaaaaatgctcctcacacccacataccatgtgtttgacatgtataaggagcaccagggcgcggaactggttgaaaagcttttattgaaaacggaaaaaaagtcggcacagacaaaatataccgttccgaacctgcatgaatccgcttcggtgaatgccgacggaaaactgcacattactctgtgcaacctgtccctcagcgaaagctacagagtagaaaccgaaatcataggaaagaaagcggaaaacgttaccggacgcattttgacaggaaagatgaacgatcataataccttcgacgcacctgaaacagttaagccccagacatttgacaaaatatccgttagacagaacggccttgttattgaaataccacccgtcagcgtagtcagcattacggttgactga

SEQ ID NO: 210 - DNA, 2838 bp, Clostridium stercorarium
atgagaaaattttggtcttttgcaataattatatctttacttgtaacaggattgtttattcatactcctaaagctgaggcagctggttacaattacggcgaagctcttcaaaaggcaataatgttttacgagtttcagaggagcggaaagttgccagagaacaagagggacaattggaggggtgacagcggcttaaatgatggagcagatgttggtttagaccttacaggcggatggtatgatgctggtgatcacgtgaagtttaatttgcctatggcatatagtcaaactatgttagcttgggcagcttacgaagcagaagaagctcttgaaagatcaggccagatgggatatttgttagacgcaataaaatgggtttctgattatcttataaaatgccacccaagtcctaatgttttttactaccaggtgggtgatggccacttggaccattcatggtggggcccggcagaagtaatgcaaatggatagaccagcttataaagtagaccttgctaatccaggttctacagtagtggcagaggctgcagctgctttggctagcgctgcagtagtttttgcagatagagatcctgcatacgctgcaacttgtatacaacatgcaaaggagttgtataattttgcagagattacaaagtcagattctggctacacagcagctagtggcttttacgatagccactcaggattttatgacgagcttagctgggctggcgtttggctttatttagctacaggcgatgaaacataccttaacaaagctgaacaatatgtggcatactggggtactgagccacaaacaaatataatttcttataagtgggcacattgttgggacgacgttcattacggagcttgcttgcttttagcaaaaattactggcaaacaaatatacaaagaggcaatagaaagacaccttgattattggagcgttggttacaacggagagagggttcattatacacctaagggattggcttggttggatagctggggaagtcttagatatgctacgacaactgcatttttggcaagtgtttacgcagattgggagggctgcagcagggaaaaagctgcaatttataatgactttgctaaacaacagatagattacgcattgggctcaagtggtagatcttatgtagttggttttggcgtgaatccgccaaaaagaccgcaccacaggactgctcacagttcttgggctgattctatgagtgttcctgactaccacagacacgtacttataggtgctttagttggaggcccaggtaaggacgattcatacacggatgacataaacaattatataaataacgaggttgcttgcgattacaatgctggttttgtgggcgcattggctaagatgtatgaagattacggcggatctccgatacctgacttgaatgcttttgaggaaataactaacgatgaattttttgttatggcaggaattaatgcatctggccagaattttatagagattaaggcattacttcataatcaatcaggttggcctgctagggtagcagataagttaagttttaggtattttgtcgatttaacggagttaatagaggctggatacagcgcttctgacgtcacaataactacaaattataacgcaggcgcaaaagtaactggtttacacccatggaatgaagctgagaacatttattacgtgaacgttgattttacgggaacaaagatatatcctggcggtcagtcagcatacagaaaagaggtgcagtttaggattgctgctccacagaatacgaatttttggaataatgacaacgattattcatttagggatataaaaggcgttacaagcggcaatacagtcaaaacagtgtatattcctgtttatgacgatggtgtgttagtttttggagtggaaaatggaataaagtacggtaacacttacttaagagaaggaacggattacacggtcagcggcgacactgtgacaatattgaaatcatttcttaatagctttgatacttcaacagttcagttaatatttgactttagcgctggtagggatccagtattgacagtgaacataattgacacgacaacgagcgcaagcatagtcccaacaacggcagattttgacaaaaatccggatgcatctagagatgttaaagtgaaattagtacctaatggaaatacgcttcttgcagtgaaaaaagacggtgaggctttggtgttaggcagggactacagtatagatggcgacgaggtaacaatatttagggagtatttagctgatcagccggtaggcagagtgactcttacatttgactttgataggggtactgatccggttttaacaattaatataacggatagcaggcaagtagagacaggagttatacaaattcagatgtttaacggcaacacgagtgataaaactaacggtataatgccgaggtacaggttgacaaacactggaacaacacctataagattgagtgatgtaaaaataaggtactactacacaatagacggagagaaggatcaaaatttttggtgcgactggtcaagtgtaggttctaataatattacgggtacatttgtaaagatggctgagccaaaagagggcgcagattattaccttgaaacgggttttactgatggcgctggctatttgcagccaaatcaaagcattgaggttcagaacagatttagtaaggcagactggactgattatatacaaacgaatgattatagctttagcactaacacgtcatacggttcaaacgacaggattactgtgtacattagcggtgtgttggttagcggaatagaacca

SEQ ID NO: 211 - DNA, 2742 bp, Clostridium stercorarium
atgaaaagaaggttaatgaagggaatatcattgttaacgcttgtatttttgattggtataatgttgcaacttagcttaaagagcgaattaacagcttacgctagtagcgatgacccttacaagcagaggtttttggaattatgggaggaattgcatgacccttctaatggttattttagttcacacggcattccttaccatgcagttgaaacattaatagtggaagctcctgactacggccacttgactacatcagaagcaatgtcttactatttatggttggaggctttatacggcaaatttacaggtgactttagctattttatgaaggcatgggagacaattgaaaaatacatgatacctacagagcaagaccagcctaacaggagcatggcaggctataaccctgcaaaaccggctacgtacgcacctgaatgggaagaaccgagtatgtacccatcacagttagactttagcgcaccagtgggcatagacccaatatacaacgagttggttagcacatacggaacgaacacaatatacggtatgcactggttgcttgacgttgataattggtacggctttggaagaagggcagatagaattagttctccagcttatataaacacttttcagaggggaagtcaggagagcgtatgggaaacaatacctcaaccgtgttgggatgacttaacaattggaggaagaaatggctttcttgacttgtttgtgggagacagtcagtactcagcacaatttaagtatacaaacgcaccggacgctgatgctagagctatacaggcaacatactgggcaaaccagtgggcaaaagaacatggagttaatttgagtcaatacgtgaaaaaggcatcaagaatgggtgattaccttagatatgcaatgtttgataaatattttagaaaaattggcgactctaagcaggctggaacgggatacgatgcagcacactacttacttagctggtactacgcttggggaggcggtataacagctgattgggcttggattataggctgctcacacgttcacgctggctaccaaaatccaatgacagcatggattcttgctaacgacccggaatttaaaccagaatctcctaacggagcaaacgactgggctaagagcttggaaaggcaattagagttttaccaatggcttcaaagtgctgaaggcgcaatagctggaggtgctacaaattcttacaaaggaagatacgaaacattgccggctggtattagcacattttacggtatggcatacgaagaacaccctgtgtaccttgatccaggtagtaacacatggtttggctttcaggcttggacgatgcagagggttgcagagtactattacttaactggtgacacaagagctgagcagcttttggataaatgggtggattggattaaaagcgtggttaggttaaactcagatggcacatttgaaattcctggcaacttggagtggtctggacagcctgatacgtggactggtacatatactggaaaccctaatttacatgtaagtgtcgtttcttataggactgacttgggcgcagctggatctttggctaatgctttgctttattatgcaaagacaagcggcgacgatgaggctagaaatttagctaaagaattgcttgacagaatgtggaacctttacagagatgacaagggattgagcgcaccggaaactagagaggattatgtgaggttttttgaacaagaagtctacgtgccacagggttggagcggaacaatgcctaatggcgatagaattgaacctggtgttacttttcttgatataaggagtaaatacttgaatgatccggactatcctaagttgcaacaggcttacaacgaaggaaaagcaccggtctttaattatcacagattttgggctcaatgcgacatagctatagcaaacggattgtacagcattttatttggctctgagcaagcaaacgattcatttataacacctacaagtgcaacatttgacaaaaacaatcaggaagatatatctgtaacagtgacttataatggcaacactttgcttggcataaagagcggttcttcatatttgatagaaggcgttgactatatagtcaatggcgacgtgattattataaagaaagagtttcttgctggtcaggctacaggaagtattagcttgctttttgactttagcgcaggcttagacagaacattaacaattgacataatagacactggtggaggcgaagagccggttgagccagtagaacctgttgagggtgttttaattatacagtcatttaacgcaaacacacaggagatttcaaatagcattatgcctaggtttagaatttataattcaggtaatacaagcattccattgagcgaagtgaaacttaggtattactacacagtagacggcgataaacctcaaaatttttggtgcgattgggcatctattggttcatctaatgtgactggaacatttgtgaaaatggatggagctacaacgggtgctgattactatttagagataggatttactccgcaggctggcactttagagcctggagctagtatagaagtacagggtaggtttagtaaaatagactggacggactatactcagactaatgactatagctttaacccgacagcttcttcatatgtggactttaacaagattactgcatacataagcggcaaccttgtttatggtattgagcct

SEQ ID NO: 212 - DNA, 5133 bp, Anaerocellum thermophilum
ggatcatttaattatggtgaagcattacaaaaagctataatgttttacgagtttcagatgtctggcaagttgcctaactgggtaagaaacaactggaggggagatagcgcattgaaagacggtcaagataatggcttagaccttactggaggttggtttgatgctggcgatcatgttaagtttaatttgccaatgagttatactggaacgatgttatcatgggcagtgtacgaatataaagacgcttttgtcaaaagcggtcagcttgagcacattttgaatcaaatagagtgggtaaatgattactttgtgaagtgtcacccgtctaaatatgtctactactaccaggttggcgatggaagtaaagatcatgcatggtggggtcctgctgaagtaatgcaaatggaaagaccatcatttaaggttacacagtctagcccgggcagtactgtagtgacagaaacggcagcttcattagcagctgcatctattgttcttaaagacaggaatcctactaaggctgcaacatatttgcaacatgctaaagaattatatgagtttgcagaagtcacaaaaagcgatgctggatatacggcagcaaatggttattataactcatggagtggcttttacgatgaactttcttgggctgcagtatggttgtatttagctactaatgacagcacataccttacgaaggcagagtcatatgttcaaaattggccaaaaataagtggatctaacactattgattacaaatgggctcattgctgggatgacgtgcacaatggtgcagctttattgcttgcaaagataacaggcaaagatatttataaacagataatagaaagccatttagattattggattacgggatacaatggtgaaagaataaagtatactcctaaaggattggcttggcttgaccaatggggctcattaaggtacgcaacaacaacggcttttttggcatttgtatatagtgattgggttggttgtccatctactaagaaagagatttatagaaaatttggagagagccagatagattacgctcttggctcagctggtagatcttttgtcgtaggatttggcacaaacccgcctaagaggccacatcacagaactgctcattcaagttgggcagacagccaatctattccttcatatcacaggcacactttatacggtgctttggtgggaggcccaggtagtgatgatagctatacagacgatatatctaattacgttaataacgaagtagcatgcgattataatgcaggatttgtcggcgctcttgcaaaaatgtatcagttatacggtggaaatccgatacctgactttaaagctattgaaacgccaactaatgatgaattttttgtggaagcaggcataaacgcttcaggaacaaattttattgagataaaggcaattgttaataaccaaagtggttggcctgctaaagcaacggataaattgaagtttagatattttgtagaccttagcgaattaataaaagctggatactctccaaatcagttaactttgtcaacaaattataaccaaggcgcaaaggttagtggtccgtacgtatgggatgctagcaaaaatatttattatatacttgtcgattttacgggaactttaatataccctggcggtcaagacaaatataagaaagaggtgcagtttagaattgcagctccacaaaatgttcagtgggataactctaatgactactcatttcaggatataaagggagtcagtagcggctctgtagtgaaaacaaaatatattcctttgtacgacggtgacgttaaggtctggggagatggcccgggtacatctggagctacgccgactccaacagcaacggcaacgcctactccgacacctactgttactcctacgccgacacctacgccgacttctactgcaactccgacgcctacgcctactccaacggtgacaccgactcctacgccaacgcctactgcaacaccgacaagcacgccaacaccaacttctacgccatcaagcacaccggttgctggcggacagattaaagtcttgtacgcaaataaggagactaattctacaacgaacacgattaggccatggttaaaagtggtcaatacaggatcatcttcaatagacttatctagggtaacgattagatactggtatacggttgacggcgataaagcacaaagcgctatatctgactgggcacagattggtgcaagtaacgttacgtttaaatttgtaaagttatcatctagtgtttctggagcagattattaccttgaaataggctttaaaagcggagcaggacagttacaagctggaaaggatacgggcgagattcaaataaggtttaataaaagcgattggtctaattataaccaaggaaacgactggtcatggatgcagagcatgacaaactatggcgaaaatgtgaaagtaactgcttatattgatggagtattagtgtggggacaagaaccaagcggtgctacacctacgccaactgctacgcctgcaccgacagtaactcctacgccgacaccaacaccgacgagtacacctacggcaactccgactgctacgccgacaccaactccaacgccgagctctactcctgtggcaggcggtcaaataaaggtactttatgctaacaaagaaacgaacagcactacaaatacaataagaccgtggcttaaggtcgtaaacactggcagttcaagtattgatttgagcagagttacaataaggtattggtacacagtggatggagacaaggctcagtcagcaataagcgattgggctcaaataggcgcttcaaatgtgacgtttaaatttgtaaaattgagtagttcagtcagcggcgctgactactatttagagattggatttaagtctggtgctggtcaacttcaggctggtaaagacactggtgaaatacagattagatttaacaagtcagattggagtaactataatcaaggaaatgattggagttggatgcagtctatgacgaattacggagagaacgtaaaggttacagcatacatagacggcgtgcttgtatggggtcaggaaccttcaggtgcaactccgactccaacagcaacgccggctcctacggttacaccgactcctacgccgactcctacgtcaacgccgactgctacacctacagcaacaccaacgcctactcctacaccttcttcaacgcctagcgttgtaggtgaatacggacagagatttatgtggttgtggaataaaattcacgatccggctaacggctattttaatcaagatggtataccatatcactctgtcgagactcttatttgtgaaagacctgactacggacacttaacaacatcagaagcatttagttattacgtgtggttggaggctgtttacggcaagttgacgggtgattggagcaaatttaaaactgcatgggatacattagaaaagtacatgataccgtctgctgaggaccaaccaatgaggtcatacgatcctaataaaccagcaacttacgctggagagtgggaaacacctgataaatacccgagtccattggaatttaacgtacctgtaggtaaggacccacttcataatgagttagttagcacgtatggatctactttgatgtacggcatgcactggcttatggatgtagataattggtatggttacggaaaaagaggcgacggtgtctcaagggcaagttttattaacacatttcagagaggacctgaagaaagcgtgtgggagacagttccgcatccatcttgggaagaatttaagtggggcggtcctaatggatttttagatttatttataaaagatcaaaattattcaaaacagtggagatatacggacgcacctgatgctgatgcaagggctattcaagcaacttactgggctaaggtatgggcaaaagagcagggcaaatttaatgaaataagtagctacgtggctaaggcagctagaatgggtgactacttgaggtacgcaatgtttgataaatattttaaaccacttggatgccaagataagaacgctgcaggcggtacaggatacgactctgctcactatttactttcatggtactacgcatggggcggtgctttagacggagcatggagttggaaaataggaagctctcacgttcattttggctaccagaatcctatggctgcatgggcattggctaacgattcagatatgaagccgaaaagtccaaacggtgcaagcgattgggctaaatctcttaagagacaaattgagttttatagatggttacaatcagcagaaggagctatagcaggcggtgctacgaatagttggaatggaaggtatgaaaaataccctgcaggcactgctacattttatggtatggcatacgagccaaaccctgtatatcacgatccgggaagcaatacgtggtttggctttcaggcttggtctatgcaaagagttgtagaatactattatgtcactggtgacaaagatgcaggagctttgcttgaaaagtgggtgtcatgggttaaatcagtagtcaaattaaatagtgatggcacatttgcaattccaagcacattggactggaagaggcagcctgatacgtggaacggtgcttacactggaaattctaatcttcatgtgaaagttgtagattatggcacagacttaggtataacggcatcattggcaaacgctcttttatactatagtgcaggaactaagaaatacggcgtctttgatgagggtgctaaaaatttggcaaaggaacttttagatagaatgtggaaattgtatagggacgaaaaaggacttagcgctccggagaagagggcagattataaaagattttttgaacaagaagtgtacattccagctggctggataggtaagatgcctaatggagatgttataaaatctggcgtaaaatttattgacataaggtcaaagtataaacaggatccagattggcctaaattagaggcagcttacaagagtggtcaagcaccggaatttagatatcatagattttgggctcagtgtgacattgcaatagctaacgcaacatatgaaattttgtttggaaatcaa

SEQ ID NO: 213 - DNA, 2458 bp, Anaerocellum thermophilum
atgaggaaaattattttaaagttttgtgcacttatgatggtagtgatattgattgtgtcaatacttcaaattttgcctgtgtttgctcagtcaatattatatgaaaaggaaaagtacccgcatttacttggtaatcaggttgtcaaaaagccaagcgtggctggtaggttgcagattatagagaaggatggcaagaaatatttagctgatcaaaaaggtgaaataattcagttgaggggtatgagcacacacggcttacaatggtatggagatataataaacaagaatgcttttaaggctcttagcaaggactgggaatgcaacgtcataaggttagctatgtatgtgggagagggtggatatgcttcaaatccttcaattaaagagaaagtgatagagggtataaagttggcaattgaaaatgatatgtatgtgattgtcgactggcatgttttaaacccgggcgatcctaacgcagagatttataagggagcaaaagatttttttaaagaaatagctactagctttcctaacgactatcatattatatacgagctttgcaatgagccaaaccctaatgagccaggtgttgaaaattctttagacggatggaaaaaggtgaaagcatatgctcaacctattataaagatgttgaggtcattgggaaatcaaaacataattatagtgggaagccctaattggagtcagaggccggattttgcaatacaagatccgataaacgacaaaaacgtgatgtactctgtacacttttacagcggcacgcataaagtcgacggatatgtatttgagaatatgaaaaacgcttttgagaatggtgtgcctatttttgtgagcgaatggggaacgagtcttgcatctggagatggtggaccatatttagatgaagctgataaatggttagaatatttaaacagcaactacatatcatgggtaaactggtcattgagcaataaaaacgagacaagcgcagcttttgtaccttacataaatggcatgcacgatgctactccacttgatcctggtgatgataaggtctgggatattgaagagttgtctataagcggtgagtatgtgagagcaaggataaaaggaattgcttaccaaccaattaaaagggacaataagataaaagagggtgagaatgcacctttgggcgaaaaggtacttccaagcacatttgaggatgacacaaggcagggctgggattgggatggaccatctggcgtaaaaggcccaattactatagaatcagctaatggctcaaaagcattatcttttaacgtggaatacccggagaagaaacctcaagatggctgggcaacagcagctagattgatattgaaggacataaatgtcgagaggggcaataataagtaccttgcatttgacttttatcttaagccggacagagcttcaaaaggtatgatacagatgtttttggcttttagcccacctagtttaggatactgggctcaagttcaagattcttttaacatagatttgggtaagacggtcaagtgtaaaaaggacaggagaacggaggtttacaagtttaacgtgttttttgatttggacaagatacaggacaacaaggtgctttcaccggacacattgttaagggatattatagtcgttattgcagatggaaacagtgactttaagggaaagatgtacattgataacgtgaggtttacaaacacattgtttgaagatattaattttgaaaactctttatatgacgttatagataaactttatagcaagggaataattaaaggtatatctgtctttaagtatttaccagataagaatataacgagagctgagtttgcagctttatgcgtaagagctcttaatttaaaaattgagaagtacgatggtaggtttagcgacgtcaaaagcggtaattggtactcagatgtggtttacacggcatacaagaacaaattatttgagataaaggaaaataagttttttcctgagaatatattgaagagggaagaggctgtggcattggctatagaagtttacaagagacttacaggcaaaatagaggtgaatacagacgacgttccaatagctgacgagaagttaattaacccacagtacagggaaagcgttaagttggctataaagttgggtatagtggatttgtactcagacggaacttttgagccaaataaatctgtatcaagaggcgaagtagcaactattttatacaaccttctcgagtgataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttt

SEQ ID NO: 214 - DNA, 2067 bp, Anaerocellum thermophilum
gtgagtgtttgtctttataaaaggttgaaaaggttttcagtattgattttagtaattttatttttgattgtaaccttaattggtatagaaactactaaaactagtagagtcattggagaaacaaaaaagagttttgtggagtataattttgaaaataggtttatagcaccatttaaagcgtcaggaaaatctatgagtttaaggattgacaatacaacagcagcagaagggaccttttcacttcttgcaagtggccgaaagcaaatagatgatggaattttgcttgatgtaaccaatcttatagattatgcaaatgaatataaaattactctatatgtttatcacaagtcaagcaaaatgcagcgttttgttgtgagtagcgaaattgagacaaaaagcggaaagaaaacaaaactgctgtgtgaaaaaattattattccaaaaagttggaaaaaacttgatgcaaatttaaatttgactgagcaaaaagggataaaaaaagtttggctaaaggtatatgtgccaacctcaaccacaaatttttacgttgacctttttacactcaaagttgctgacaaatctcatctaataaaatttgaaaactttgaagataaaagtatagcaggatttatctctcaagataaaaaatgtaaattatccatttcaaaagaaaaagcttaccaaggtacatatagcataaaagttcagcaaacagttaaaagacaaaacacaacagttatcttgcctgtaaaaggaacatttgaaaaggggaaaagttattcaatatctttttatatgcatcaatccattctaaagagtttaaattttgcagttggtataaggtttctggaaagtggaaagaatatgagagagattgtgcttgggagggtaaccattccaaagaataagtggacagaagtatttgcaagttatacgccctctttggattcaaagataaaagactttgtgattttcataagacccctctcagatatttcctattactatatcgacaactttacaatttcagatgatggatggtattcagctgtacctgatttagatttaccttctttgagagagaaatacaaaaactactttaaaattggtgttgctgtaccatacagggctttgacaaatccagttgatgttgctttcataaagagacattttaacagcattacagcagagaatgagatgaagccagaagcacttgaaccaatagaggacaatttcaacttttcaattgctgatgagtatcttaatttctgcagaaagaataatatagctattcgtggtcacaacttgttgcatcagcaaaccccaaactggttttttgaaaaccctcagacagggaaaaagctgacgaatagtgaaaaagacaaaaagatacttttagagaggctaaaaaagtatatccagacagttgtttcaagatacaaggggagaatatatgcatgggatgtggtaaatgaagctattgatgagaatgagccagatggatttagaagaagtgactggtttaatgtattgggtccagagtatatcgaaaaagcgttcatatacgctcatcaggcagaccctaacgctcagcttttttacaatgactacagcacagaaaatccagtaaagagagaatatatttacaagctaataaagagtctaagagaaaaaggaatacccattcatggtgttggtcttcagtgtcatatttctgtaagctggccaagcgttgaagaggtagaaaaaactataaaactttttagcagcattcctggtattaagatacatgtcacagaaattgatataagtgtggcaaaagaatatggtgaagacatagatgaagaaacaaaaagatatcttttgattcagcaggcaagaaagttaaaagatctttttgatgtgttcaaaaaatacaaaaatgtagtaacaagtgtttcgttctggggactcaaagatgactattcatggcttcaaggtgattttccacttttgtttgacaaagattatcaaccaaaatttgctttctggagcttaatagacccgtcagttgtgccagaagaataa

SEQ ID NO: 215 - DNA, 1028 bp, Anaerocellum thermophilum
aaggtatttatccaaaaccaaatataaactactacgttaatccagagcttgagggcaaaaacagtcttgaagtatttgacatagttgtacaaatatgtaaagaagttggtttgaaaattatgttggatattcacagcataaaaacagacgcaatgggacatatctatccagtatggtatggacttgataaatttactccagaggatttttataaggcgtgtgagtggattacaaatagatataaaaatgatgatactattatagcttttgacctaaaaaatgagccacatggaaaaccatggcaagacacaacatttgcaaaatgggataattcaacagatattaataattggaaatatgcggctgaaacatgtgcgaaacgtatactaaatataaatccaaaccttcttattgtaatagaaggaattgaagcgtatccaaaagatgacgttacatggacatcaaaatcctatagcgattactattcaacatggtggggcggtaacttgcgaggtgttaaaaagtatcctattaatctgggtaaatatcaaaataaagtagtatattcacctcatgattacggaccctctgtttaccagcagccgtggttttatccaggcttcacaaaagaatctttactacaagattgttggcgtccgaattgggcttacatcatggaagaaaacattgcgccgctgctgataggtgaatggggtggttatcttgatggagctgataacgaaaagtggatgagatatctacgagattatattatagagaatcatattcatcacacattttggtgctttaatgctaactcaggtgacactggaggtatggttggatacgattttacgacatgggatgaaaaaaaatactcatttttaaagccggctctttggcaagacagtcaaggtaggtttgttggattagatcacaagcgacccttaggtacaaatgggaaaaacattaatattacaatatactacaacaataatgaaccagcgccagttccagccgcaaaatga

SEQ ID NO: 216 - DNA, 4245 bp, Anaerocellum thermophilum
tcattttgcggctggaactggcgctggttcattattgttgtagtatattgtaatattaatgtttttcccatttgtacctaagggtcgcttgtgatctaatccaacaaacctaccttgactgtcttgccaaagagccggctttaaaaatgagtattttttttcatcccatgtcgtaaaatcgtatccaaccatacctccagtgtcacctgagttagcattaaagcaccaaaatgtgtgatgaatatgattctctataatataatctcgtagatatctcatccacttttcgttatcagctccatcaagataaccaccccattcacctatcagcagcggcgcaatgttttcttccatgatgtaagcccaattcggacgccaacaatcttgtagtaaagattcttttgtgaagcctggataaaaccacggctgctggtaaacagagggtccgtaatcatgaggtgaatatactactttattttgatatttacccagattaataggatactttttaacacctcgcaagttaccgccccaccatgttgaatagtaatcgctataggattttgatgtccatgtaacgtcatcttttggatacgcttcaattccttctattacaataagaaggtttggatttatatttagtatacgtttcgcacatgtttcagccgcatatttccaattattaatatctgttgaattatcccattttgcaaatgttgtgtcttgccatggttttccatgtggctcattttttaggtcaaaagctataatagtatcatcatttttatatctatttgtaatccactcacacgccttataaaaatcctctggagtaaatttatcatcataccatactggatagatatgtcccattgcgtctgtttttatgctgtgaatatccaacataattttcaaaccaacttctttacatatttgtacaactatgtcaaatacttcaagactgtttttgccctcaagctctggattaacgtagtagtttatatttggttttggataaataccttgcgaccagttcagtataatctcggctgatattggaattcttagcaaattaaagcctctattggctatttcagctagagtatcttttagattgcaactccatacaccatcaaaaacatttgtacctgtattgtatccaaaccagttaatacctgttaaccataccggtttaccatctttatcaactattttattaccacttacataaagccaatcatcatttgtatcatcaagaatactcggtgttgatgttggatttggagttactgttggcattggtattactgtctgcaccggtgttggtgtcggtgtcggggttgccgttactgttggggtcggggttggtgttggtgctggtgttgctgtcggtgtcactgtcggtgctggtgttgctgtcggtgttggtgtcgctccactcggctcctgtccccataccaatacaccatctatatacgctgttaccttcacattctctccataactcgtcatgctctgcatccatgaccagtcattcccctgattgtaattgctccagtcactcttgttaaaccttatctgtatctcccctgtgtctttaccagcctgcaactgcccagctccactcttaaatcctatctctaaataatagtccgctccacttacgctactgctcagcttcacaaacttgaatgtcacattgcttgctcctatctgtgcccagtctgatatcgcactctgtgccttgtccccatctaccgtgtaccagtaccttatcgttaccctgctcaaatctatgctgctgcttccagtgttcactaccttcaaccatggccttatcgtgtttgttgtgctatttgtctccttgttagcatacaatacctttatctgtccacctgctacaggtgtactgctcggcgtcggtgttggggtagcagttggtgttggtgttggagtcggtgttggcgttggtgtagcagttggtgttggggtcggggttggtgttggtgctggtgttgctgtcggtgttggtgtcgctccactcggctcctgtccccataccaatacaccatctatatacgctgttaccttcacattctctccataactcgtcatgctctgcatccatgaccagtcattcccctgattgtaattgctccagtcactcttgttaaaccttatctgtatctcccctgtgtctttaccagcctgcaactgcccagctccactcttaaatcctatctctaaataatagtccgctccacttacgctactgctcagcttcacaaacttgaatgtcacattgcttgctcctatctgtgcccagtctgatatcgcactctgtgccttgtccccatctaccgtgtaccagtaccttatcgttaccctgctcaaatctatgctgctgcttccagtgttcactaccttcaaccatggccttatcgtgtttgttgtgctatttgtctccttgttagcatacaatacctttatctgtccacctgctacaggtgtactgctcggcgtcggtgttggggtagcagttggtgttggtgttggagtcggtgttggcgttggtgtagcagttggtgttggggtcggggttggtgttggtgctggtgttgctgtcggtgttggtgtcgctccactcggctcctgtccccataccaatacaccatctatatacgctgttaccttcacattctctccataactcgtcatgctctgcatccatgaccagtcattcccctgattgtaattgctccagtcactcttgttaaaccttatctgtatctcccctgtgtctttaccagcctgcaactgcccagctccactcttaaatcctatctctaaataatagtccgctccacttacgctactgctcagcttcacaaacttgaatgtcacattgcttgctcctatctgtgcccagtctgatatcgcactctgtgccttgtccccatctaccgtgtaccagtaccttatcgttaccctgctcaaatctatgctgctgcttccagtgttcactaccttcaaccatggccttatcgtatttgttgtgctatttgtctccttgttagcatacaatacctttatctgtccacctgctacaggtgtgctgctcggcgtcggtgttggtgttggcgttgctgttggtgtagcagttggtgttgacgttggtgttggtgtaggtgtcggtgttggagtcagtgttggtgttggtgttgctgttggtgtagcagttggtgtcggtgttggtgttgaagtaggtactgaagaggcaccaatcgcattagttttataccattgcccccatggagttggattattggggtcccaattgtttaccatgtccaagtaccctacatagctcgaattgccacaccaagaccagctaaaaagtcctatcttgtattgttttgcatacctgacaatagcttcctcgtcagggtcaccatctgtatgctgatgcccaaactccccaataactaatggcagccctttctccacaaatgacttgatatattcttctaccttgctcgctgtattgtatacaccgtacatatgaatcgaaaataccaaattgcgcagcggatctgcttccattatgctctgggcattgtctctcatagtattagaccaatcctgcccccagttcggtgcatcaaccattatcgtgtgcttgaaccctgcatcccttagcgcttttatagcattcttcgtgtcattaatccagttttgatagttattgttcccatacggctcattaccaatgtttattataacaaaatcctcattgccttctaacacactctttatctctttccaatattctactgcttgcgccaatgaacatgctgcaccgtcctcaccatatcctgtcgtgtcgtgaacttctaatacaatggctctgaatccaagacttcttgacaatgatataatatttgctacttcacttgctggtatcttcgtccatcgatagccattactcaacactaccctcacagagttcataccccatgaccttattcctcgcaatgccgtctcaagtttatctctgtaccagcaatgtgcgtgatttgttcctattaatgtgctagtatctatcttcactactccatcattagatgtagccgcaccaactttgggtaaattcgttacatttgctataaacaaaatgttcaataaaaaaacaactgtacatagtatactcaaccatttcttccccatttttgtttttactctcat

SEQ ID NO: 217 - DNA, 2268 bp, Anaerocellum thermophilum
atgaggaaaattattttaaagttttgtgcactcatgatggtagtgattttgattgtttccattttacaaatattacctgtatttgcccagagcatactgtatgaaaaggaaaaatatccacatcttcttggcaatcaggtagttaaaaaaccatcggttgccggcagactgcagattattgaaaaggacggaaaaaagtatttagctgaccagaaaggagaaataattcagcttcgtggtatgagtacacatggacttcagtggtatggtgatattataaacaaaaatgcatttaaagctctttcaaaagattgggagtgcaacgttataaggcttgcgatgtatgtgggtgaaggcggatatgcttcaaacccaagtattaaagaaaaagttatagaagggattaagcttgctattgagaatgacatgtatgtaattgttgactggcatgtattaaatcccggtgacccgaacgcagaaatttataaaggggcaaaagactttttcaaagagatagctacaagttttcccaatgactatcacataatatatgaactttgcaatgaaccaaatccaaatgaaccgggagtagaaaatagcttggatggctggaaaaaagtaaaggcttatgcacagcccatcataaaaatgctcagaagtttggggaatcagaacattataattgtaggttcgccaaactggagtcagagacctgactttgcaattcaagaccctataaatgataagaatgttatgtattcagttcatttttactctggaactcacaaagttgatggatatgtttttgaaaacatgaaaaatgcgtttgaaaatggcgtgccaattttcgtgagtgaatggggaacaagtttggcaagcggtgatggtggaccgtatcttgatgaagcagataagtggcttgaatatttaaattcaaactatattagctgggtgaactggtcgctgtcaaacaaaaatgagacatcagctgcttttgttccatatataaatggtatgcatgatgccacaccacttgaccctggtgatgataaggtgtgggacatagaagagcttagtatttctggagagtatgtgagggcaaggataaaaggaattgcttatcagccaattaagagagataacaaaataaaagaaggagaaaatgcacctttaggcgaaaaagtcttaccatccacgtttgaagatgacactcgtcagggctgggattgggatggaccatctggtgtgaaaggtcctattactatcgaaagtgcgaatggttcaaaagcgctatcttttaatgttgagtatccagagaaaaaaccacaagatggctgggcaacagctgcaaggcttatacttaaagacataaatgtagaaaggggaaataataaatatttggcttttgatttttatttgaaaccagatagggcttcaaaaggtatgattcagatatttttagctttttcaccaccttccttaggttactgggctcaggtacaagacagttttaatattgaccttgcaaaactgtcaagtgcaaaaaagatagaagacagaatttataagttcaatgtattttttgacttagacaagatacaagataataaagtactgagtccagacacactcttgagagatataatagtagtcatagcagatggcaatagcgattttaaggggaaaatgtatatagataatgttagatttaccaatatcctttttgaggatatcaattttgaaaatagcctttatgatgttatagacaagctttattctaaaggaatcataaaaggaatttcagtatttaagtacttgccagataaaaacattacaagggctgaatttgctgcactttgtgtcagggcactgaacctgaaaattgaaaaatacgatggtagattttctgatgtgaaaagcggcaactggtattcagatgtagtttatacggcgtataaaaacaaattgtttgaaataaaagagaataaattctttcctgaaaatattttaaaaagagaagaagcagtagctttggcaattgaagtgtataaaagattgactggtaagatagaagttaatacagacgatgttccaattgctgatgaaaaacttataaatcctcaatacagagaaagcgtgaagttagcaattaagctcggtattgttgacctgtattcagacggaacatttgaaccaaataagagcgtttcaagaggggaggtggcaacaattctctataatctcttgaacttagcaggcaagctatga

SEQ ID NO: 218 - DNA, 2622 bp, Thermobifida fusca
atggtcagcttcacctccttgttggctggtgttgctgctatttctggtgttttggctgctccagctgctgaagttgaaccagttgctgttgaaaagagagaagctgaagccgaagccgaaccagcattcaactacgctgaagctttgcaaaagtctatgttcttctacgaagctcaaagatctggtaagttgccagaaaacaacagagtctcttggagaggtgactccggtttgaacgatggtgccgatgttggtttggacttgaccggtggttggtacgacgctggtgaccatgttaaattcggtttcccaatggctttcactgccactatgttggcttggggtgccatcgaatctccagaaggttacattagaagtggacaaatgccatacttgaaggataacttgagatgggttaacgattacttcatcaaagctcacccatccccaaacgtgttgtacgtccaagttggtgatggtgacgctgaccacaagtggtggggtccagctgaagtcatgccaatggaaagaccatctttcaaggtcgacccatcttgtccaggttctgacgtcgctgctgaaaccgctgctgccatggctgcttcttctattgttttcgctgacgacgacccagcttacgctgccaccttggttcaacacgctaagcaattgtacactttcgccgacacttatagaggtgtttactctgattgtgttccagccggtgctttctataactcttggtctggttatcaagatgaattggtctggggtgcttactggttgtacaaagctactggtgacgactcttacttggctaaggctgaatacgaatacgacttcttgtctactgaacaacaaaccgacttgagatcttacagatggactatcgcttgggatgataagtcttacggtacctacgtcttgttggctaaagaaaccggtaagcaaaagtacatcgatgatgctaacagatggttggattactggaccgtcggtgttaacggtcaaagagtcccatactctccaggtggtatggctgttttggatacctggggtgctttgagatacgctgccaacaccgccttcgttgctttggtttacgctaaggttatcgatgacccagttagaaagcaaagataccacgacttcgctgttcgtcaaatcaactacgctttgggtgacaacccaagaaactcttcctacgttgttggtttcggtaataatccaccaagaaaccctcaccacagaactgctcacggttcctggactgactccattgcttccccagctgaaaacagacatgtcttgtacggtgctttggtcggtggccctggttccccaaacgatgcttacactgatgaccgccaagactacgttgctaacgaagttgccaccgactacaacgctggtttctcttctgctttggctatgttggtcgaagaatacggtggtactccattggctgatttcccaccaaccgaagaaccagatggtccagaaatcttcgttgaagctcaaatcaacaccccaggtaccactttcaccgaaattaaggctatgattcgtaaccaatccggttggcctgccagaatgttggataagggtaccttcagatactggttcactttggacgaaggtgttgacccagccgacattaccgtctcttccgcctacaaccaatgtgctaccccagaagacgttcaccatgtttctggtgacttgtactatgttgaaattgactgtactggtgaaaagatcttcccaggtggtcaatctgaacacagaagagaagtccaattcagaatcgctggtggtccaggttgggacccatccaacgattggtccttccaaggtattggtaacgaattggctccagctccatacattgttttgtacgacgacggtgttccagtctggggtaccgctccagaagaaggtgaagaacctggtggcggtgaaggtccaggtggtggtgaagaaccaggtgaagacgttactccaccatctgctccaggttctccagccgtccgtgacgttacctctacttctgctgttttgacctggtctgcttcttctgacactggtggttctggtgtcgccggttacgacgttttcttgagagctggtaccggtcaagaacaaaaggtcggttccaccactagaacctccttcactttgactggtctagaaccagacactacctatatcgctgccgttgtcgctcgtgacaatgctggtaacgtttctcaaagatctaccgtttccttcactaccttggctgaaaacggtggtggtccagacgcctcttgcaccgtcggttactctactaatgactgggattctggtttcactgcttctattagaatcacctaccacggtactgctcctttgtcctcctgggaattgtccttcaccttcccagctggtcaacaagtcacccacggttggaacgctacttggagacaagacggtgccgctgttactgccaccccaatgtcttggaactcctctttggctccaggtgctaccgtcgaagtcggtttcaatggttcttggtccggttctaacactccaccaaccgacttcaccttgaacggtgaaccatgtgctttggcttaa

SEQ ID NO: 219 - protein, 459 aa, Aspergillus fumigatus
MLLQAFLFLLAGFAAKISAQQPAASSAGNPKLTTYKCTTAGGCVAQDTSVVLDWGYHWIHTVDGYTSCTTSSGVDSTLCPDAATCAKNCVIEPANYTSAGVTTSGDSLTMYQYVQSNGVYTNASPRLYLLGPDKNYVMLKLLGQELTFDVDLSTLPCGENGALYLSEMSATGGRNEYNTGGAEYGSGYCDAQCPVIAWKNGTLNTSGASYCCNEMDILEANSRANSYTPHPCSATDCDKGGCGFNPYALGQKSYWGPGGTVDTSKPFTITTQFITNDGTTTGTLSEIRRQYMQNGKVIANAVSSTGVNSITEDWCTSVDGSAATFGGLTTMGKALGRGMVLIFSIWNDASGFMNWLDSGNAGPCSSTEGNPDLIKAQNPTTHVVFSNIRWGDIGSTFKGSDGSVTTTTSTTSTKTTTSTAPGPTQTHYGQCGGQGWTGPTACASPYTCQVLNPWYSQCL

SEQ ID NO: 220 - protein, 468 aa, Neosartorya fischeri
MLLQAFLFLLAGFAAKISAQQPATSSAGNPKLTTYKCTTAGGCVAQDTSVVLDWGSHWIHTVNGYTSCTTSSGVDSTLCPDEATCAKNCVIEPANYTSAGVATSGDSLTMYQYVQNNGVYTNASPRLYLLGPDKDYVMLKLLGQELSFDVDLSTLPCGENGALYLSEMSASGGRNEYNTGGAEYGSGYCDAQCPVIAWKNGTLNTSGASYCCNEMDILEANSRANSYTPHPCSATDCDKGGCGFNPYALGQKSYWGPGGTVDTSKPFTITTQFITNDGTTTGTLSEIRRQYIQNGKVIANAVSSAGVSSITEDWCTSVDSSAATFGGLTTMGKALGRGMVLIFSIWNDASGFMNWLDSGNSGPCSSTEGNPDLIKAQNPTTHVVFSNIRWGDIGSTFKGSDDSGTTTTKTTTTKTSTSTTSTKTTTSTAPGATQTHYGQCGGQGWTGPTACASPYTCKAQNQWYSQCL

SEQ ID NO: 221 - protein, 459 aa, Aspergillus clavatus
MLLQAFLFLLAGFAAKISAQNPGAADAGNPKLTTYKCTTAGGCVKQDTSVVIDWNYHWIHTANGYDSCTTSSGVDSSLCPDAATCARNCVIEPANYTSAGVATSGDTLTMHQYIKSDGEYVNASPRLYLLGSDGDYVMMKLLGQELTFEVDLSTLPCGENGALYLSEMSATGGRNEYNKGGAEYGSGYCDAQCPVQTWKNGTLNTNGSGFCCNEMDILEGNSRANSFTPHPCSSTDCDKGGCGFNPYALGQQNYWGPGGTVDTFKPFTVTTQFITSDGTQTGTLKEIRRQYIQNGKEWCTSGASFGGLTTMGQALGRGMVLAFSIWNDNSQFMNWLDSGSNGPCSSTEGNPDLIKAQNPTTHVVFSNIRWGDIGSTFSNPGGSSSSSTTRIVTITKPTTVFPTSTKTTTIQAPTTTTTASGATQTQWGQCGGQGWSSPTACATPYTCQAQNAWYSQCVL

SEQ ID NO: 222 - protein, 469 aa, Aspergillus terreus
MLLQAFLFLLAGFAAKISAQQPSSSSPGNPSLTTWKCTTGGGCLQQDTSVVLDWGFHWIHTSNSQSCTTSSGVNSALCPDEATCAKNCVIDPANYATAGVATSGDTLTMHQYYQNNGVITNASPRLYLLGSDGNYVMLKLLGQELSFNVDLSTLPCGENGALYLSEMSATGGRNEYNTGGAQYGSGYCDAQSPVMAWRNGTLNTSGQGFGCNEMDILEANSRANSFTPHPCNGNDCDKGGCGFNPYALGQQNYWGPGGTVDTSKPFTITTQFITDDGTKTGTLKEIRRQYIQNGKIIANAKSSAGVDSITEPWCESVDGAAATYGGLKRMGEALGRGMVLIFSIWNDAGGFMNWLDSGSAGPCSSTEGNPSLIQSAHPDTHVVFSNIRWGDIGSTYTNPGGSGSSSSSTTTTTKTTSTTTTTKITTTTSAGGATQTHWGQCGGQGWTGPTACASPYTCQKQNEWYSQCL

SEQ ID NO: 223 - protein, 460 aa, Trichoderma longibrachiatum
MLLQAFLFLLAGFAAKISAQQPGTSTPEVHPKLTTYKCTTSGGCVAQDTSVVLDWNYRWMHDANYNSCTVNGGVNTTLCPDEATCGKNCYIEGVDYAASGVTASGSTLTLNQYMPSSSGGYSSVSPRLYLLGPDGEYVMLKLNGQELSFDVDLSALPCGENGSLYLSQMDENGGANQYNTAGANYGSGYCDAQCPVQTWRNGTLNTSGQGFCCNEMDILEGNSRANALTPHSCTATACDSAGCGFNPYGSGYPNYFGPGDTVDTSKTFTIITQFNTDNGSPSGNLVSITRKYRQNGVDIPSAKPGGDTISSCPSASAYGGLATMGKALSSGMVLVFSIWNDNSQYMNWLDSGRAGPCSSTEGNPSNILANNPGTHVVYSNIRWGDIGSTTNSTGGNPPPPPPPASSTTFSTTRRSSTTSSSPSCTQTHWGQCGGIGYTGCKTCTSGTTCQYGNDYYSQCL

SEQ ID NO: 224 - protein, 493 aa, Penicillium marneffei
MLLQAFLFLLAGFAAKISAQQAPTPDNTVSLPTWKCTSSGGCVQQSTSIVVDWVYHWIHTVNGSTSCTTSSGLNSALCGTEKECYTNCEISPATYDGLGIRASGNALTLNQYVTSNGTTNSVSPRVYLLDPAGKNYEMLQLLGQEISFDVDVSNLPCGENGALYLSEMDATGGRSQYNPAGASYGSGYCDAQCGTGSWFNGSINTGSLGSCCNEMDLWEANSQATALTPHPCSVDGPYGCSGSACGSTGVCDKNGCGFNPYALGDHNYYGSGYTVDTSKPFTVTTQFVTSDGTKTGALTEIRRSYVQNGKVIANAVASSSSGVSGANSITESFCTTMDSEAGTLGGLRTMGEALGRGMVLIFSIWNDAGGSMNWLDSGNSGPCSSTAGVPSTIQANDPSTSVTFSNIKWGDIGSTGPSPGGSSSSSSSSSKSSSTTISITHSTTSSSATTTTTSTGATQTHWGQCGGTGYSGPTACAPPYTCKAQNPYYSQCL

SEQ ID NO: 225 - protein, 395 aa, Chaetomium globosum
MLLQAFLFLLAGFAAKISAQQPGSVTPEVHPKLPTWQCTKSGGCVEQDTSVVLDWNYRWFHTSDNTTSCTTSSGIDSTLCPDAATCAENCVVEGTDYTSSGIETSGSSLTLRQFVKDSEGKTNSVSPRAYLLGADGDYVMFKLLNQELSFDVDVSTLPCGENAALYFSEMDKTGGRNEHNTGGAKYGSGYCDAQCPVQTWNNGTLNTSHQGSCCNEMDILEANSKAEAFTPHPCIGDNCDKGGCGFNSYARGNKNYWAPGGTLDTSKPFTMVTQFITDDGTSSGKLSQIVRSYVQNGQKVASAVSGGDSITVEGCSSSDAYGGLVGMGEALGRGMVLAMSIWNDASGFMNWLDSGDNGPCNETEGDPANILANHPDSQVVLSNIRWGDIDSTVQL

SEQ ID NO: 226 - protein, 440 aa, Neurospora crassa
MLLQAFLFLLAGFAAKISAQQIGTITPESHPKLPTKRCTLSGGCQTVSTSIVLDAFQRPLHKIGDPSTACVVGGPLCPDAATCAANCALEGVDYASLGVKTEGDALTLNQWVSDPSNPGHYKTSSPRTYLVAEDGKNYEAVKLLGKEISFDVDVSNLPCGMNGAFYLSEMLMDGGRGEFNAAGAEYGTGYCDAQCPKLDFINGEANINKTHGACCNEMDIFEANARAKSFTPHPCSIERVYKCTGDTECGQSQGVCDQWGCTYNEYQKGVHDFYGLAPPAKTIDTTQKFTVTTQFLTDNGREDGVLVEIRRLWSQNGKLIKNAKIAVDSLSTDSVSTQFCEKTSSWTMQRGGLKTMGEAMGRGMVLIFSIWADESGFMNWLDSGDSGPCSATEGDPKLILQKKPDARVTFSNIKWGEMGSTYASAGKYGVRRVAKGLSAL

SEQ ID NO: 227 - protein, 419 aa, Aspergillus oryzae
MLLQAFLFLLAGFAAKISAQQVGTTADAHPRLTTYKCTSQNGCTRQNTSLVLDAATHFIHKKGTQTSCTNSNGLDTAICPDKQTCADNCVVDGITDYASYGVQTKNDTLTLQQYLQTGNATKSLSPRVYLLAEDGENYSMLKLLNQEFTFDVDASTLVCGMNGALYLSEMEASGGKSSLNQAGAKYGTGYCDAQCYTTPWINGEGNTESVGSCCQEMDIWEANARATGLTPHPCNTTGLYECSGSGCGDSGVCDKAGCGFNPYGLGAKDYYGYGLKVNTNETFTVVTQFLTNDNTTSGQLSEIRRLYIQNGQVIQNAAVTSGGKTVDSITKDFCSGEGSAFNRLGGLEEMGHALGRGMVLALSIWNDAGSFMQWLDGGSAGPCNATEGNPALIEKLYPDTHVKFSKIRWGDIGSTYRHL

SEQ ID NO: 228 - protein, 456 aa, Thielavia heterothallica
MLLQAFLFLLAGFAAKISAQTPGEGEEVHPQITTYRCTKADGCEEKTNYIVLDALSHPVHQVDNPYNCGDWGQKPNETACPDLESCARNCIMDPVSDYGRHGVSTDGTSLRLKQLVGGNVVSPRVYLLDETKERYEMLKLTGNEFTFDVDATKLPCGMNSALYLSEMDATGARSELNPGGATFGTGYCDAQCYVTPFINGLGNIEGKGACCNEMDIWEANARAQHIAPHPCSKAGPYLCEGAECEFDGVCDKNGCAWNPYRVNVTDYYGEGAEFRVDTTRPFSVVTQFRAGGDAGGGKLESIYRLFVQDGRVIESYVVDKPGLPPTDRMTDEFCAATGAARFTELGAMEAMGDALTRGMVLALSIWWSEGDNMNWLDSGEAGPCDPDEGNPSNIIRVQPDPEVVFSNLRWGEIGSTYESAVDGPVGKGKGKGKGKAPAGDGNGKEKSNGKRFRRFL

SEQ ID NO: 229 - protein, 430 aa, Fusarium oxysporum
MLLQAFLFLLAGFAAKISAQTPDKAKEQHPKLETYRCTKASGCKKQTNYIVADAGIHGIRQKNGAGCGDWGQKPNATACPDEASCAKNCILSGMDSNAYKNAGITTSGNKLRLQQLINNQLVSPRVYLLEENKKKYEMLHLTGTEFSFDVEMEKLPCGMNGALYLSEMPQDGGKSTSRNSKAGAYYGAGYCDAQCYVTPFINGVGNIKGQGVCCNELDIWEANSRATHIAPHPCSKPGLYGCTGDECGSSGICDKAGCGWNHNRINVTDFYGRGKQYKVDSTRKFTVTSQFVANKQGDLIELHRHYIQDNKVIESAVVNISGPPKINFINDKYCAATGANEYMRLGGTKQMGDAMSRGMVLAMSVWWSEGDFMAWLDQGVAGPCDATEGDPKNIVKVQPNPEVTFSNIRIGEIGSTSSVKAPAYPGPHRL

SEQ ID NO: 230 - protein, 422 aa, Humicola insolens
MLLQAFLFLLAGFAAKISAQKPGETKEVHPQLTTFRCTKRGGCKPATNFIVDLSLSHPIHRAEGLGPGGCGDWGNPPPKDVCPDVESCAKNCIMEGIPDYSQYGVTTNGTSLRLQHILPDGRVPSPRVYLLDKTKRRYEMLHLTGFEFTFDVDATKLPCGMNSALYLSEMHPTGAKSKYNPGGAYYGTGYCDAQCFVTPFINGLGNIEGKGSCCNEMDIWEANSRASHVAPHTCNKKGLYLCEGEECAFEGVCDKNGCGWNNYRVNVTDYYGRGEEFKVNTLKPFTVVTQFLANRRGKLEKIHRFYVQDGKVIESFYTNKEGVPYTNMIDDEFCEATGSRKYMELGATQGMGEALTRGMVLAMSIWWDQGGNMEWLDHGEAGPCAKGEGAPSNIVQVEPFPEVTYTNLRWGEIGSTYQELQL

SEQ ID NO: 231 - protein, 495 aa, Pyrenophora tritici-repentis
MLLQAFLFLLAGFAAKISAAVILGWARGYCNRRWDSPKSTSEKKYFGINTVAIYNIESAVQRLPSRPRLHFFKVFSMPRYTFLTAALVGLASAQSLLGTTPEVHPKLKTWKCTKAGGCKAVNSAIVIDAGSHGIRQKNNPSLGCGDFGSTPPKSVCPDKETCAKNCVMDGISDYSALGVTTQGSSLRLDMLNSKGNEASPRVYLLAEDEKNYEMLKLTGNEFTFDVDTSKLPCGMNGALYLSEMAANGGRSKLNPGGATYGTGYCDAQCFVTPWINGEGNVKGQGVCCNEMDIWEANKAATQIAPHTCSKNSIFGCTGDECGASGLCDKNGCGDNPYNQRKSPDYYGPSKKVDTTKPFTVVTQFPAKNGVLQAIVRKYVQNGKVIENAMMNLTMDQAFCTAQGATMYNKLGGHKGMGDALSRGMVLALSIWWDKTGGMNWLDSGAAGPCSATEGFPAEIIKVEPRPTVTFSSIKWGEIGSTFKEQGSTKVPFTAL

SEQ ID NO: 232 - protein, 455 aa, Magnaporthe grisea
MLLQAFLFLLAGFAAKISAQQIGTEIPEIHPELPTQFCTRKDGCVVRKTKIVADVMFRPMHVKDNVSMPCTAAFGTALCPDAATCTRNCVLEGVDYDSLGVATKGNALKLNQYLFNGAEYKKVAPRVYLLGEDDRNYELMKLVNMELAFDVDVSQLGCGMNGALYFSEMDVSGSRSDLNPAGAAYGTGECDAQCFQDQNFTANRMATALTPHTCSKPSSFRCTGEECGKGKAGVCDKSGCQINPYKLGDKKFYGPGGTIDTNKRFTVLTQFVHEHPEAGIDISRAGPLKEIRRKYIQDGRVIEDVHTSNASFSPLKGMDQRFCDTYGSEAYTRLGGIVGTGQSMARGMVLIFSIWNSEGDFMKWLDAGDRGPCGPTDGDPKKIKQETPNVSVTYSNIKWGELGTVLGHDASPGAKGDEAKARLAANSGGATAPAVTGGSVLGLAIVLLALVHLFL

SEQ ID NO: 233 - protein, 434 aa, Fusarium graminearum
MLLQAFLFLLAGFAAKISAQTPDKTQEKHPKIETYRCTKAKGCKKATNYIVADAELHGISQANGQSCGNWGEAANSTACPDEATCAKNCKLFGMNEAAYKAKGISTSGNALRLEMLRNGQSVSPRVYLLEENKNKYEMLKLTGAEFSFDVETQKLPCGMNGALYLSEMPADGGKSTSKYSKVGAAQGGGYCDAQCYVTPFINGVGNIKGKGVCCNEMDIWEANSRATHIAPHPCSVPGLYGCTGAECQKDGICDKAGCGWNHNRNGVPDFYGRGKNFKVDTTRKFTVVSSFPADKSGKLTEMHRHYIQDGKVIKSAVVTLPGPPKVTGNIITDNYCKASHADDYIRLGGTEEMGDAMTRGMVLAMSVWWSEGDSMEWLDGQGAGAGPCTKEEGLPKNIVKVEPNPEVTFSNIRIGEIGSTHAVKMPRVYGAHRL

SEQ ID NO: 234 - protein, 475 aa, Hypocrea jecorina
MVSFTSLLAGVAAISGVLAAPAAEVEPVAVEKREAEAEAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQC

SEQ ID NO: 235 - protein, 419 aa, Hypocrea jecorina
MNKSVAPLLLAASILYGGAVAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNEDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTSSGNSWTDTSLVSSCLARKL

SEQ ID NO: 236 - protein, 389 aa, Chrysosporium lucknowense
MKSSILASVFATGAVAQSGPWQQCGGIGWQGSTDCVSGYHCVYQNDWYSQCVPGAASTTLQTSTTSRPTATSTAPPSSTTSPSKGKLKWLGSNESGAEFGEGNYPGLWGKHFIFPSTSAIQTLINDGYNIFRIDFSMERLVPNQLTSSFDEGYLRNLTEVVNFVTNAGKYAVLDPHNYGRYYGNVITDTNAFRTFWTNLAKQFASNSLVIFDTNNEYNTMDQTLVLNLNQAAIDGIRAAGATSQYIFVEGNAWSGAWSWNTTNTNMAALTDPQNKIVYEMHQYLDSDSSGTHAECVSSNIGAQRVVGATQWLRANGKLGVLGEFAGGANAVCQQAVTGLLDHLQDNSEVWLGALWWAAGPWWGDYMYSFEPPSGTGYVNYNSILKKYLP

SEQ ID NO: 237 - protein, 417 aa, Polyporus arcularius
MHSFSGLLVAVALAVSVKAQTTLSPVWGQCGGTGWTGPTACATGSVCTKLNDAHFQCVPGTATTAPSSPSTTSSAPAPTSSCQIPAPSAGKLRFAGVNIAGFDFGCSTDGTCSASGAWPPLTQYYGNDGEGQMQHFVKDDGFNVFRLPVGWQYLTDGVLGGTIDEDNFEEYDALVQACLNTGASCIIDIHNYARWNGKIIGQGGPTNEQFAELWSSVAAKYANNSKIIFGVMNEPHDVPDINLWAESVQAAVTAIRKAGATSQIILLPGNNWTSAETFISNGSGAALMKVTNPDGSTTNLVFDVHKYLDSDNSGTHEECVTNNIDNAWAPLAEWLRCNGRQAFNTETGGGNVASCQQFMCEQVAFQNANSDVFLGYVGWAAGNFYQGYALGEVPTYSNGQWVDTSLVSSCLAPNARK

SEQ ID NO: 238 - protein, 521 aa, Aspergillus kawachii
MRISNLIVAASAATMVSALPSRQMKKRDSGFKWVGTSESGAEFGSALPGTLGTDYTWPETSKIQVLRNKGMNIFRIPFLMERLTPDGLTGSFASTYLSDLKSTVEFVTNSGAYAVLDPHNYGRFDGSIIESTSDFKTWWKNVATEFADNDKVIFDTNNEYHDMEQSLVLNLNQAAINGIRAAGATTQYIFVEGNAYTGAWDWTTYNDDLSGLTDSEDKIIYEMHQYLDSDSSGTSETCVSSTIGKERIEKATEWLKTNNKQGIIGEFAGGVNSVCEEAVEGMLAYMSENSDVWVGASWWSAGPWWGTYMYSLEPTDGTAYSTYLPILEKYFPSGDASSSSSASASVAAATSAVSTTTTAAFEQTTTPATQVEIASSSSSSSAVAASQTTLSKVKSKSKSPCKLSSATSSAVSSAAAVTTPAVAATTPAAAPTSSSVAFATTSVYVPTTTAAAPSQVSSSAAASSSGVVGVSDPQGPSATNSAGEVNQYYQCGGINWTGPTVCASPYTCKVQNDYYYQCVAE

SEQ ID NO: 239 - protein, 419 aa, Heterodera schachtii
MHWADVACSRPPWPRDSVKALKCNWNANVIRGAMGVDEGGYLSDANTAYNLMVAVIEAAISNGIYVIVDWHAHNAHPDEAVKFFTRIAQAYGSYLHILYEDFNEPLDVSWTDVLVPYHKKVIAAIRAIDKKNVIILGTPKWSQDVDVASQNPIKDYQNLMYTLHFYASSHFTSDLGAKLKTAVNNGLPVFVTEYGTCEASGNGNLNTDSMSSWWTLLDSLKISYANWAISDKSEACSALSPGTTAVNVGVSSRWTSSGNMVASYYKKKSTGISCSGSSSGSSSGSSSGSSGTSSGSSGSSSGSSSGSSSGSSGSSSGSSSGSGSASISVVPSNTWNGGGRVNFEIKNTGSVPLCGVVFSVSLPSGTTLGGSWNMESAGSGQYSLPSWVRIEAGKSSKDAGLTFNGKDKPTAKIVTTKKC

SEQ ID NO: 240 - protein, 471 aa, Orpinomyces sp.
MKFLNSLSLLGLVIAGCEAMRNISSKELVKELTIGWSLGNTLDASCVETLNYSKDQTASETCWGNVKTTQELYYKLSDLGFNTFRIPTTWSGHFGDAPDYKISDVWMKRVHEVVDYALNTGGYAILNIHHETWNYAFQKNLESAKKILVAIWKQIAAEFGDYDEHLIFEGMNEPRKVGDPAEWTGGDQEGWNFVNEMNALFVKTIRATGGNNANRHLMIPTYAASVNDGSINNFKYPNGDDKVIVSLHSYSPYNFALNNGPGAISNFYDGNEIDWVMNTINSSFISKGIPVIIGEFVAMNRDNEDDRERWQEYYIKKATALGIPCVIWDNGYFEGEGERFGIIDRKSLNVIFPKLINGLMKGLGDEKPKTTIRRTTTTTVQVQPTINNECFSTRLGYSCCNGFDVLYTDNDGQWGVENGNWCGIKSSCGNNQRQCWSERLGYPCCQYTTNAEYTDNDGRWGVENGNWCGIY

SEQ ID NO: 241 - protein, 399 aa, Irpex lacteus
MKSLLLSAAATLALSTPAFSVSVWGQCGGIGFTGSTTCDAGTSCVHLNDYYFQCQPGAATSTVQPTTTASSTSSAAAPSSSGNAVCSGTRNKFKFFGVNESGAEFGNNVIPGTLGTDYTWPSPSSIDFFVGKGFNTFRVPFLMERLSPPATGLTGPFDSTYLQGLKTIVSYITGKGGYALVDPHNFMIYNGATISDTNAFQTWWQNLAAQFKTDSHVVFDVMNEPHDIPAQTVFNLNQAAINRIRASGATSQSILVEGTSYTGAWTWTTTSGNSQVFGAIHDPNNNVAIEMHQYLDSDGSGTSPTCVSPTIGAERLQAATQWLQQNNLKGFLGEIGAGSNADCISAVQGALCEMQQSDVWLGALWWAAGPWWGDYFQSIEPPSGVAVSSILPQALEPFL

SEQ ID NO: 242 - protein, 384 aa, Chaetomium globosum
MKSSILAGVFATGAVAQSGAWGQCGGNGWQGATTCVSGYHCAYQNDWYSQCLPGGASTTLRTSTTTSSAPAATSTSPAKGKFKWFGINQSCAEFGTPTYPGIWGKHFTFPSTSSIQTLINDGYNTFRVAFSMERLVPDQLTSTTFDAGYLRNLTETVDFITNAGAYAVLDPHNYGRYYGDIITDTNAFKTFWTNLATKFVSNSRVVFDTNNEYNTMDQTLVLNLNQAAINGIRAAGATQHIFVEGNAWSGAWSWNTTNTNMVALTDPQGKLVYEMHQYLDTDSSGTSPDCVSAEIGVQRVVGATNWLRANGKIGIIGEYAGGPNTVCQTAVTNLLEHLKANSDVWQGALWWAGGPWWGDYMYSFEPPSGTGYTNYNSILKKYAP

SEQ ID NO: 243 - protein, 416 aa, Aspergillus niger
MRISNLIVAASAASMVSALPSRQMKKRDSGFKWVGTSESGAEFGSALPGTLGTDYTWPETSKIQVLRNKGMNIFRIPFLMERLTPDGLTSSFASTYLSDLKSTVEFVTNSGAYAVLDPHNYGRFDGSIITSTSDFKTWWKNVATEFADNDKVIFDTNNEYHDMEQSLVLDLNQAAINGIRAAGATTQYIFVEGNAYTGAWDWTTYNDNLSGLTDSEDKIIYEMHQYLDSDSSGTSETCVSSTIGQERLEKATEWLKTNNKQGIVGEFAGGVNSVCEEAVEGMLAYMSENSDVWVGASWWSAGPWWGTYMYSLEPTDGTAYSTYLPILEKYFPSGDASASSSASVSVAAATSTASTTTAAFEQTTTPATQGPSATNSAGEVNQYYQCGGINWTGPTVCASPYTCKVQNDYYYQCVAE

SEQ ID NO: 244 - protein, 411 aa, Penicillium decumbens
MRSSHKRNLAALLSISGAAVAQQTAWGQCGGQGWSGATSCVSGYTCSYTNDWYSQCVPGSSGGGGSNPTTTTTMIRTTTTASSSGPTGGAGGGKVRFAGVNIAGFDFGVVISGTQDMTQIVDESVDGVNQMRHFVNDDGFNIFRLPSGWQFLVNNNLGGSLDSNNFAKYDKLVQGCLSLGAYCIVDVHNYARWNGGVIGQGGPTDDQFTSLWTQLATHYKSESKIIFGVMNEPHDLDINRWATTVQKAVTAIRKAGATSQMILLPGTDFTSAANFVENGSGAALSAVTNLDGSTTNLIFDVHKYLDSDNSGTHAECVTNNADAFNSLAQWLRTNKRQAMLTETGGGNVQSCGTYMCQQLDVLNQNSDVYLGWTSWSAGGFQVSWNYVLGEVPTNNVDTYLVKQCFVPKWKN

SEQ ID NO: 245 - protein, 234 aa, Trichoderma reesei
MKFLQVLPALIPAALAQTSCDQWATFTGNGYTVSNNLWGASAGSGFGCVTAVSLSGGASWHADWQWSGGQNNVKSYQNSQIAIPQKRTVNSISSMPTTASWSYSGSNIRANVAYDLFTAANPNHVTYSGDYELMIWLGKYGDIGPIGSSQGTVNVGGQSWTLYYGYNGAMQVYSFVAQTNTTNYSGDVKNFFNYLRDNKGYNAAGQYVLSYQFGTEPFTGSGTLNVASWTASIN

SEQ ID NO: 246 - protein, 237 aa, Phanerochaete chrysosporium
MFKALLAVGFAIALTFASAAQTITGQYDCIPAGAYTLCQNLWGEYAGVGSQNSTLISTNGNAVTWQTNWTWANNPNTVKSCASHSFPIASSAPTAWNWTYVTESQGIRADVSYDIWFGKAQSGNPATSASSYEIMIWLSGLGGIQPVGHQILSGLNIAGHTWNLWSGPNSNWQVFSFVISSGEVRNFSADLNEFFQYLIQSQGVASTQYLQAIQVGTEPFVGSASLLTESFAVAVNV

SEQ ID NO: 247 - protein, 237 aa, Stachybotrys echinata
MKVAALLVALSPLAFAQSLCDQYSYYSSNGYEFNNNMWGRNSGQGNQCTYVDYSSPNGVGWRVNWNWSGGDNNVKSYPYSGRQLPTKRIVSWIGSLPTTVSWNYQGNNLRANVAYDLFTAANPNHPNSSGDYELMIWLGRLGNVYPIGNQVATVNIAGQQWNLYYGYNGAMQVYSFVSPNQLNYFSGNVKDFFTYLQYNRAYPADSQYLITYQFGTEPFTGQNAVFTVSNWSAQQNN

SEQ ID NO: 248 - protein, 234 aa, Neosartorya fischeri
MKTFAILGAFFSSALAQTLCDQYATYSNGRYTVNNNLWGKSSGSGSQCTYVDSISNSGVAWHTTWTWSGGDNQVKSYANSQVSLTKKLVSQISSIPTTVQWSYDNTNTRADVAYDLFTAADINHVTYSGDYELMIWLARYGSVQPIGSQIDSVNIGGHTWELWYGGSTQKTYSFVSATPITSFSGDVMDFWDYLTSRHGYPASSQYLINMQFGTEPFTGGPATLRVSQWTASVN

SEQ ID NO: 249 - protein, 247 aa, Chaetomium brasiliense
MKLTLVLFVSSLAAATPLGWRERRQQVSLCGQSSSWSGNGYQLNNNLWGQSRATSGSQCTYLDSSSNSGIHWHTTWTWEGGEGEVKSYAYSGRQVSTGLTIASIDSMQTSVSWEYNTTDIQANVAYDIFTAEDPDHEHSSGDYEVMIWLARYNNVSPIGSSVATATVGGDTWDLFAGANGDMEVYSFVAENTMNSFSGDVKDFFDYLEQNVGFPVDDQYLLVFELGSEAFTGGPATLSVSQFSANIA

SEQ ID NO: 250 - protein, 349 aa, Chaetomium globosum
MSKASALLATLTGAALVAAHGHVSHIIVNGVYYENYDPTTHWYQPNPPTVIGWKAAQQDNGFVEPNNFGTSDIICHKSGSPGGGHATVAAGDKISIVWDPEWPESHIGPVIDYLAACNGDCETVDKASLRFFKIDGAGYDKTAGRWAADTLRANGNSWLVQIPADLKAGNYVLRHEIIALHGASSPNGAQAYPQCINLRVTGSGTNAPSGVAGTSLYRASDAGILFNPYVASPNYPVPGPALIAGAASSVAQSKSVATATASATLPGNNNGGGPNPQPTTATTTANPGVSTTLRTSTSTSTSAQVTPPPTGGNAQTKYGQCGGSGWTGPTACAAGSSCSVLNDWYAQCV

SEQ ID NO: 251 - protein, 373 aa, Aspergillus fumigatus
MSVPKIAAALLSSAALVAGHGFVTGAVVDGKYYTGYLVNQYPYMSSPPDSIGWSETATDLGFVDGSGYSSGDIICHKDAKNGAISAEIKAGGKVEFQWTEWPESHHGPVITYMANCNGDCASVDKTTLEFFKIDESGLISDSNVPGTWASDNLIANNNSWTVTVPSSIAAGNYVMRHEIIALHSAGNQNGAQNYPQCINLKVTGGGSDKPAGTLGTALYKNTDAGILVNIYQSLSSYEIPGPALYSGASSGSSNNGGSASSSATAPSATITQPSTAVPTSSATAYQPSTTTEAVTVTSIPAQQSYVQAPTATPSSTAGSSGSGSGSSSSGTLPSSSNLTEYFNSLSAEEFLKVLKQTFSWLVTEKVHARDLSA

SEQ ID NO: 252 - protein, 319 aa, Humicola insolens
MRPFSLVALATAVSGHAIFQRVSVNGVDQGQLKGVRAPSSNYPIENVNHPDFACNTNIRHRDGTVIKIPAGATVGAWWQHEIGGPSFPGDPDNPIAASHKGPIQVYLAKVDNAATASPNGLRWFKIAEKGLSGGVWAVDEMIRNNGWHYFTMPQCIAPGHYLMRVELLALHSASFPGGAQFYMECAQIEVTGSGNFSPSETVSFPGAYPANHPGIVVSIYDAQGNANNGGREYQIPGPRPITCSGGGSNNGGGNNNGGGNNNGGGGNNNGGGNNNGGGNTGGGSAPLWGQCGGNGYSGPTTCAEGTCKKQNDWYSQCTP

SEQ ID NO: 253 - protein, 382 aa, Neosartorya fischeri
MSQTKSLSLLAVLLSATRVAAHGHVTNVVVNGVSYAGFDINSYPYMSDPPKVAAWTTPNTGNGFIAPSAYNSPDIICHQNATNAQAYIEIAAGDRIQLQWTAWPESHHGPVIDMLASCGESCTTVDKTSLKFFKIDGVGLVDNSAVPGTWGDDQLIANSNSWMVEIPKSIAPGNYVLRHELIALHGAFEEGGAQNYPQCFNLKVTGSGTDSPAGTLGTELYTESDPGLLVDIYKSIASYAVPGPAMYSGAVSITQTTSAITSTGTATVGSGADSTPVPSSAASSKYSTIAVQVPTTKAQYTPVPSSSPSTFVTSPAPSTPVPSSSSVPVTSSTAAPQPTPAPGGTQTAYGQCGGRNWTGPTACASGSTCKTWNPYYSQCVPN

SEQ ID NO: 254 - protein, 326 aa, Thielavia terrestris
MKSFTIAALAALWAQEAAAHATFQDLWIDGVDYGSQCVRLPASNSPVTNVASDDIRCNVGTSRPTVKCPVKAGSTVTIEMHQQPGDRSCANEAIGGDHYGPVMVYMSKVDDAVTADGSSGWFKVFQDSWAKNPSGSTGDDDYWGTKDLNSCCGKMNVKIPEDIEPGDYLLRAEVIALHVAASSGGAQFYMSCYQLTVTGSGSATPSTVNFPGAYSASDPGILINIHAPMSTYVVPGPTVYAGGSTKSAGSSCSGCEATCTVGSGPSATLTQPTSTATATSAPGGGGSGCTAAKYQQCGGTGYTGCTTCASGSTCSAVSPPYYSQCL

SEQ ID NO: 255 - protein, 225 aa, Chrysosporium lucknowense
MHLSATTGFLALPALALAQLSGSGQTTRYWDCCKPSCAWPGKGPSSPVQACDKNDNPLNDGGSTRSGCDAGGSAYMCSSQSPWAVSDELSYGWAAVKLAGSSESQWCCACYELTFTSGPVAGKKMIVQATNTGGDLGDNHFDLAIPGGGVGIFNACTDQYGAPPNGWGDRYGGIHSKEECESFPEALKPGCNWRFDWFQNADNPSVTFQEVACPSELTSKSGCSR

SEQ ID NO: 256 - protein, 308 aa, Chaetomium globosum
MRSTPILRTALAAALPLVAYAADGKSTRYWDCCKPSCSWPGKALVNQPVYACSANFQRITDSNAKSGCDGGSAFSCADQTPWALNDDFAYGFAATSLAGGSEASWCCSCYELTFTSGPVAGKKMVVQSTSTGGDLGSNHFDLNIPGGGVGIFDGCSPQFGGLGGQRYGGVSSRSECDAFPEALKPGCYWRFDWFKNADNPNFTFRQVQSLPKPSSSSSPVAVPKPTSTPGSVPKPTSTPGSAPEPATPTSAVPSVKTSASASPSKSSSPVSCVTEKYGQCGGNGFTGCKTCTCGTTCKKQNDWYSQCL

SEQ ID NO: 257 - protein, 315 aa, Acremonium thermophilum
MRSSPFLRAALAAALPLSAHALDGKSTRYWDCCKPSCGWAGKASVNQPVFSCSADWQRISDFNAKSGCDGGSAYSCADQTPWAVNDNFSYGFAATAIAGGSESSWCCACYALTFNSGPVAGKTMVVQSTSTGGDLGSNQFDLAIPGGGVGIFNGCASQFGGLPGAQYGGISDRSQCSSFPAPLQPGCQWRFDWFQNADNPTFTFQRVQCPSELTSRTGCKRDDDASYPVFNPPSVPGLDGSNPGNPTTTVVPPASTSTSRPTSSTSSPVSTPTGQPGGCTTQKWGQCGGIGYTGCTNCVAGTTCTQLNPWYSQCL

SEQ ID NO: 258 - protein, 305 aa, Humicola insolens
MRSSPLLPSAVVAALPVLALAADGRSTRYWDCCKPSCGWAKKAPVNQPVFSCNANFQRITDFDAKSGCEPGGVAYSCADQTPWAVNDDFALGFAATSIAGSNEAGWCCACYELTFTSGPVAGKKMVVQSTSTGGDLGSNHFDLNIPGGGVGIFDGCTPQFGGLPGQRYGGISSRNECDRFPDALKPGCYWRFDWFKNADNPSFSFRQVQCPAELVARTGCRRNDDGNFPAVQIPSSSTSSPVNQPTSTSTTSTSTTSSPPVQPTTPSGCTAERWAQCGGNGWSGCTTCVAGSTCTKINDWYHQCL

SEQ ID NO: 259 - protein, 299 aa, Thielavia terrestris
MRSTPVLRTTLAAALPLVASAASGSGQSTRYWDCCKPSCAWPGKAAVSQPVYACDANFQRLSDFNVQSGCNGGSAYSCADQTPWAVNDNLAYGFAATSIAGGSESSWCCACYALTFTSGPVAGKTMVVQSTSTGGDLGSNQFDIAMPGGGVGIFNGCSSQFGGLPGAQYGGISSRDQCDSFPAPLKPGCQWRFDWFQNADNPTFTFQQVQCPAEIVARSGCKRNDDSSFPVFTPPSGGNGGTGTPTSTAPGSGQTSPGGGSGCTSQKWAQCGGIGFSGCTTCVSGTTCQKLNDYYSQCL

SEQ ID NO: 260 - protein, 395 aa, Chrysosporium lucknowense
MKFVQSATLAFAATALAAPSRTTPQKPRQASAGCASAVTLDASTNVFQQYTLHPNNFYRAEVEAAAEAISDSALAEKARKVADVGTFLWLDTIENIGRLEPALEDVPCENIVGLVIYDLPGRDCAAKASNGELKVGELDRYKTEYIDKIAEILKAHSNTAFALVIEPDSLPNLVTNSDLQTCQQSASGYREGVAYALKQLNLPNVVMYIDAGHGGWLGWDANLKPGAQELASVYKSAGSPSQVRGISTNVAGWNAWDQEPGEFSDASDAQYNKCQNEKIYINTFGAELKSAGMPNHAIIDTGRNGVTGLRDEWGDWCNVNGAGFGVRPTANTGDELADAFVWVKPGGESDGTSDSSAARYDSFCGKPDAFKPSPEAGTWNQAYFEMLLKNANPSF

SEQ ID NO: 261 - protein, 383 aa, Magnaporthe grisea
MLFSSVLLGLTATAGVSAMPRNRGSSPRHIRRQEGANPFEGKKLFANPEWAEKAEPALAHYESIGDSANAARVRKVQQTGTFVWVSNIASLPNIDAAIEGARAAKEATGEDQIVGLVHYNLPDRDCSAGESAGELDSTKDGLRLYKETYVAPFAEKLAAATDLTFAVVLEPDSLANLVTNMGVEFCARAAPVYEEGIAHAIKSLQFDHVHLYLDAAHGGWLGWDDNLAPTAKEFAKVVAMAGGNSTVRGVVTNVSNYNPFIMPEPLEPYTEWSNSYDESHYALSLAPHLEAEGLPSRFLIDQGRVHLPGAREEWGEWCNVEPAGFGIAPGTPTENPHVDSIVWVKPGGESDGECGMEGATRAGAWFEEYFRMLVENAHPSLDS

SEQ ID NO: 262 - protein, 421 aa, Chaetomium globosum
MRSFTLLAGLLATASALPAIEPRQSGNPFSGRTLLVNPSYSESLEQTRQALANAGDQTSAGKVKFVQDKVGTFVWISNIALLADIDKAITNARAAKAKGENPVIGLVLYNIPDRDCSAGESSGELSFAQNGLARYKSEYVTPFAQKLKAASDLQFAVVLEPDAMGNMVTGTTAFCQNARGPQQDGIAYAIQQLQASNVALYLDVANGGWLGWPDNLELTADVVATILQKAGGNNRIRGYASNVSNYNPYKSANPPAYTEGSPSPDESRYADNLAAAFGQRGLPTKFIIDQGRVALDGARKEWGEWCNVYPSGFGQPFTTNTGNNNVDAIVWIKPGGESDGQCGMPGAPRAGAWFDAFAQQLAKNAHPDITAGGGNNGGGGNPGGGNCAARWAQCGGQGFTGPTCCSEGTCTVSNQWYSQCL

SEQ ID NO: 263 - protein, 365 aa, Humicola insolens
MAKKLFITAALAAAVLAQSGNPFSGRTLLVNSDYSSKLDQTRQAFLSRGDQTNAAKVKYVQEKVGTFYWISNIFLLRDIDVAIQNARAAKARGENPIVGLVLYNLPDRDCSAGESSGELKLSQNGLNRYKNEYVNPFAQKLKAASDVQFAVILEPDAIGNMVTGTSAFCRNARGPQQEAIGYAISQLQASHIHLYLDVANGGWLGWADKLEPTAQEVATILQKAGNNAKIRGFSSNVSNYNPYSTSNPPPYTSGSPSPDESRYATNIANAMRQRGLPTQFIIDQSRVALSGARSEWGQWCNVNPAGFGQPFTTNTNNPNVDAIVWVKPGGESDGQCGMGGAPAAGMWFDAYAQMLTQNAHDEIAR

SEQ ID NO: 264 - protein, 383 aa, Neurospera crassa
MRALSLLAALSAAGATVTASPVGPAHAPRALSDSNPFVGKKLFANPKWASKLEDTYKAFTSRGDSENAAVVRKVQKIGSFVWVSSRSGLSEIDEAIQAARAEQSRTGQKQIVGLVMYNIPDRDCSAGESAGELSTKNDGLRIYKEQFVKPYAAKLAAAKDLQFAVVVEPDSLGNSVTNSAVEFCKQAIPTYREGIAFAIKSLQLDNVAVYLDAANGGWLGWGDSLPKAADEIATILSMASPAKVRGFSTNVSNYNPYLATKRDSFTSGSPSYDESHYASSLAPYLQQHGLPAHFIIDQGRVAYPGARKDWGDWCNVNPAGFGHIPTTDQSVLQNSNVDAIVWIKPGGESDGQCGLKGAPIAGAWFGGYAEMLTGNADASVKNS

SEQ ID NO: 265 - protein, 838 aa, Trichoderma reesei
MKVSRVLALVLGAVIPAHAAFSWKNVKLGGGGGFVPGIIFHPKTKGVAYARTDIGGLYRLNADDSWTAVTDGIADNAGWHNWGIDAVALDPQDDQKVYAAVGMYTNSWDPSNGAIIRSSDRGATWSFTNLPFKVGGNMPGRGAGERLAVDPANSNIIYFGARSGNGLWKSTDGGVTFSKVSSFTATGTYIPDPSDSNGYNSDKQGLMWVTFDSTSSTTGGATSRIFVGTADNITASVYVSTNAGSTWSAVPGQPGKYFPHKAKLQPAEKALYLTYSDGTGPYDGTLGSVWRYDIAGGTWKDITPVSGSDLYFGFGGLGLDLQKPGTLVVASLNSWWPDAQLFRSTDSGTTWSPIWAWASYPTETYYYSISTPKAPWIKNNFIDVTSESPSDGLIKRLGWMIESLEIDPTDSNHWLYGTGMTIFGGHDLTNWDTRHNVSIQSLADGIEEFSVQDLASAPGGSELLAAVGDDNGFTFASRNDLGTSPQTVWATPTWATSTSVDYAGNSVKSVVRVGNTAGTQQVAISSDGGATWSIDYAADTSMNGGTVAYSADGDTILWSTASSGVQRSQFQGSFASVSSLPAGAVIASDKKTNSVFYAGSGSTFYVSKDTGSSFTRGPKLGSAGTIRDIAAHPTTAGTLYVSTDVGIFRSTDSGTTFGQVSTALTNTYQIALGVGSGSNWNLYAFGTGPSGARLYASGDSGASWTDIQGSQGFGSIDSTKVAGSGSTAGQVYVGTNGRGVFYAQGTVGGGTGGTSSSTKQSSSSTSSASSSTTLRSSVVSTTRASTVTSSRTSSAAGPTGSGVAGHYAQCGGIGWTGPTQCVAPYVCQKQNDYYYQCV

SEQ ID NO: 266 - protein, 857 aa, Aspergillus niger
MRRTFAALVAGYLLDSVHAAASQAYTWKNVVTGGGGGFTPGIVFNPSAKGVAYARTDIGGAYRLNSDDTWTPLMDWANNSNWHDWGIDAIATDPVDTDRVYVAVGMYTNDWDPNDGSILRSTDQGDTWEETKLPFKVGGNMPGRGVGERLAVDPNDNSILYFGARSGNGLWKSTDYGETWSNVTAFKWTGTYFQDSSSTYTSDPVGIAWVTFDSTSGSSGSPTPRIFVGVVDTGESVFVSEDAGETWTWVSGEPMYGFLPHKGILSPSEHTLYISYSNGAGPYDGTNGTVHKYNITSGVWTDISPTSMTDTYYGYGGLAVDLQVPGTVMVAALNCWWPDELIWRSTDSGGTWSPIWAWNGYPSINYYYSYDISNAPWLQDDTSTDEFPVRVGWMVEALAIDPFDSDHWLYGTGETIYGGHDLQNWDSEHNVTIESLAVGIEEMAVLGLITPPGGPALLSAVGDDGGFYHTSLTTAPSQYYHTPTYSSTNGIDYAGNKPANIVRSGSSDSDPTLALSSSFGESWYADYAASSSTATGQVALSADADTILLMNSDGAYRSANSATLSAVSSLPSGAVIASDKANNTYFYGASGSSFYLSSDTAATFTVTTTLGSSTTANAIRAQPSLAGDVWVSTDTGLFHSTNYGKSFTQIGSGCTEGWSFGFGKPSSDGDYPVLFGFFTVDGVTGLFKTEDQGVNWQIISDAEHGFGSASANVVNGDLQNYGRVFVGTNGRGIFYGDPSGTLPSATATASSASSTAVKSSTSTSTSKVGSSTTVSSSTATTITTSSIKSTTLTTTTKSSSSTTSTSSTATGTASAYGQCGGSGFTGPTQCPSGWTCTYENEYYSQCKSIPGIATDRG

SEQ ID NO: 267 - protein, 856 aa, Aspergillus aculeatus
MARSSLALLCAALLGKLADAAASQAYTWKNVVTGGGGGFTPGIVFNPSAKGVAYARTDIGGAYRLNSDDTWTPLMDWVGNDTWHDWGIDALATDPVDTDRVYVAVGMYTNEWDPNVGSILRSTDQGDTWTETKLPFKVGGNMPGRGMGERLAVDPNKNSILYFGARSGHGLWKSTDYGATWSNVTSFTWTGTYFQDSSSTYTSDPVGIAWVTFDSTSGSSGSATPRIFVGVADAGKSVFKSEDAGATWAWVSGEPQYGFLPHKGVLSPEEKTLYISYANGAGPYDGTNGTVHKYNITSGVWTDISPTSLASTYYGYGGLSVDLQVPGTLMVAALNCWWPDELIFRSTDSGATWSPIWEWNGYPSINYYYSYDISNAPWIQDTTSTDQFPVRVGWMVEALAIDPFDSNHWLYGTGLTVYGGHDLTNWDSKHNVTVKSLAVGIEEMAVLGLITPPGGPALLSAVGDDGGFYHSDLDAAPNQAYHTPTYGTTNGIDYAGNKPSNIVRSGASDDYPTLALSSNFGSTWYADYAASTSTGTGAVALSADGDTVLLMSSTSGALVSKSQGTLTAVSSLPSGAVIASDKSDNTVFYGGSAGAIYVSKNTATSFTKTVSLGSSTTVNAIRAHPSIAGDVWASTDKGLWHSTDYGSTFTQIGSGVTAGWSFGFGKASSTGSYVVIYGFFTIDGAAGLFKSEDAGTNWQVISDASHGFGSGSANVVNGDLQTYGRVFRGHERPGHLLRQSQREPAGRHGDGDGDTTTSKTSTTVSTTLKTTTSSASTTSSSTTVKTTTSSSSTTSKASSTTTTKTTTTSTTTSSGTTATASAYAQCGGNGWTGATVCFTGYTCTYSNAFYSQCVPS

SEQ ID NO: 268 - protein, 846 aa, Neosartorya fischeri
MMHTLNVVLLAAGLLFDVAHAAASQAYTWKNVVTGGGGGFVPGIVFNPSAKGVAYARTDIGGAYRLNSDDTWTPLQDSVGNSNWHDWGVDALATDPVDTSRLYLAVGMYTNEWDPNVGSIMRSTDKGNTWSETKLPFKVGGNMPGRGMGERLAVDPNKNSILYFGARSGHGLWRSTDYGATWSNVTSFIWTGTYFQDASSTYTSDPVGIAWVTFDSTSGSNGSPTPRIFVGVADTSKSVFVSEDAGSTWSWVTGEPQYGFLPHKGVLSPAEKTLYISYSNGAGPYDGTNGTVHKYNITSKVWTDISPTPMASTYYGYGGLSVDLQVPGTLMVAALNCWWPDELIFRSVDSGATWSPIWAWNGYPNLNYYYSYDISNAPWLQDDTSTAQFPVRVGWTVEALAIDPFDSNHWLYGTGATIYGGHDLKQWDTVHNVTLKSLAVGIEEMAVLGLISPPGGPPLLSAVGDVGGFYHSDLDKAPAQSFHNPTYGTTNGIDYAGNKPSNLVRSGASDTLPTVAMSTDFGKTWSANYAASSTTPTGQVALSADADTVLLMNSNGVMVSKYSSTFSAVSSLPSGAAIASDKSNNTVFYGGSAGAFYVSTDGATSFTKTASLGSSTAVNAIRAHPSIAGDVWATTDTGLWHSTDYGKTFTKIDGGCTAGWSFGLGKASPTGSYAVIYGFFTVDGTTALFKTEDMGMNWQMISDSTHGFGAASANVVNGDMSNYGRVFVGTNGRGIFYGQPSGSLPSPTATATTTKTTSTSTKTSGTTTSSTTLSTTTKTSTTTTSTTKTTTSPTSTGTSTPYGQCGGTGYTGPTACPSGWKCTYQNAYYSQCEFEHLKKTGKHLDR

SEQ ID NO: 269 - protein, 261 aa, Chaetomium thermophilum
MVNFSTLFLAASTAALAAAAPSIEKRQTLTSSATGTHNGYYYSFWTDGQGNIRFNLESGGQYSVTWSGNGNWVGGKGWNPGTDNRVINYTADYRPNGNSYLAVYGWTRNPLIEYYVVESFGTYDPSTGATRMGSVTTDGGTYNIYRTQRVNAPSIEGTKTFYQYWSVRTSKRTGGTVTMANHFNAWRQAGLQLGSHDYQIVATEGYYSSGSATVNVGGSTTGGNNGGNNGGNNGGNNGGNTGSNVSISRPRKMGSLASTRS

SEQ ID NO: 270 - protein, 229 aa, Trichoderma reesei (synthetic version)
MVAFSSLICALTSIASTLAMPTGLEPESSVNVTERGMYDFVLGAHNDHRRRASINYDQNYQTGGQVSYSPSNTGFSVNWNTQDDFVVGVGWTTGSSAPINFGGSFSVNSGTGLLSVYGWSTNPLVEYYIMEDNHNYPAQGTVKGTVTSDGATYTIWENTRVNEPSIQGTATFNQYISVRNSPRTSGTVTVQNHFNAWASLGLHLGQMNYQVVAVEGWGGSGSASQSVSN

SEQ ID NO: 271 - protein, 229 aa, Trichoderma reesei (native version); identical to SEQ ID NO: 270

SEQ ID NO: 272 - protein, 383 aa, Chrysosporium lucknowense
MRTLTFVLAAAPVAVLAQSPLWGQCGGQGWTGPTTCVSGAVCQFVNDWYSQCVPGSSNPPTGTTSSTTGSTPAPTGGGGSGTGLHDKFKAKGKLYFGTEIDHYHLNNNALTNIVKKDFGQVTENSLKWDATEPSRNQFNFANADAVVNFAQANGKLIRGHTLLWHSQLPQWVQNINDRNTLTQVIENHVTTLVTRYKGKILHWDVVNEIFAEDGSLRDSVFSRVLGEDFVGIAFRAARAADPNAKLYINDYNLDIANYAKVTRGMVEKVNKWIAQGIPIDGIGTQCHLAGPGGWNTAAGVPDALKALAAANVKEIAITELDIAGASANDYLTVMNACLQVSKCVGITVWGVSDKDSWRSSSNPLLFDSNYQPKAAYNALINAL

SEQ ID NO: 273 - protein, 361 aa, Aureobasidium pullulans
MHFSTITAALALLGLGAATPTDYSTSSYSKNQGLAQAWTSKGRQYIGTALTIRDDPVEQGIIQSRTDFNSITPENAMKWESTEPQRNNFTFAGADAVADFADRYNKEMRCHTLVWHSQLPAWVSQGNFDNKTLISIMENHIKKVAGRYKNKCTHWDVVNEALNEDGTYRSSVFYNTIGEAFIPIAFRFAEKYAGSKTKLYYNDYNLEYGSAKALGAQRILKLVQSYGVQIDGVGLQAHLSSEATASTGGGVTPDVQTLTNVLKLYTDLGVEVAYTELDVRFTTPATDAKLKAQADAYARVVQSCINVKRCVGITVWGVSDKYSWIPGVFPTEGAALLWDENFNKKPAYSSVLKTIQSFRKS

SEQ ID NO: 274 - protein, 931 aa, Aspergillus niger
MRHSIGLAAALLAPTLPVALGQHIRDLSSEKWTLSSRALNRTVPAQFPSQVHLDLLRAGVIGEYHGLNDFNLRWIAAANWTYTSQPIKGLLDNYGSTWLVFDGLDTFATISILWTANRIHGQSVSPVSGSMYLPALEACQRRILIRKVSFRGGVTAEVNTCYLHIEWPDDVQLTYEYPNRWFMRKEQSDFGWDWGPAFAPAGPWKPAYIVQLDKKESVYVLNTDLDIYRKNQINYLPPDQSQPWVVNASIDILGPLPAKPTMSIEVRDTHSGTILTSRTLNNVSVAGNAITGVTVLDGLNPKLWWPQSSVIRTSTMFLSLSKVEGTRPWPVWTNGRASAPFFLNQRNITEVQRAQGIAPGANWHFEVNGHEFYAKGSNLIPPDSFWTRVTEERISRLFDAVVVGNQNMLRVWSSGAYLHDYIYDLADEKGILLWSEFEFSDALYPSDDAFLENVAAEIVYNVRRVNHHPSLALWAGGNEIESLMLPRVKDAAPSSYSYYVGEYEKMYISLFLPLVYENTRSISYSPSSTTEGYLYIDLSAPVPMAERYDNTTSGSYYGDTDHYDYDTSVAFDYGSYPVGRFANEFGFHSMPSLQTWQQAVDTEDLYFNSSVVMLRNHHDPAGGLMTDNYANSATGMGEMTMGVISYYPIPSKSDHISNFSAWCHATQLFQADMYKSQIQFYRRGSGMPERQLGSLYWQLEDIWQAPSWAGIEYGGRWKVLHHVMRDIYQPVIVSPFWNYTTGSLDVYVTSDLWSPAAGTVDLTWLDLSGRPIAGNAGTPKSVPFTVGGLNSTRIYGTNVSSLGLPDTKDAVLILSLSAHGRLPNSDRTTNLTHENYATLSWPKDLKIVDPGLKLGYSSKKTTVTVEATSGVSLYTWLDYPEGVVGYFEENAFVLAPGEKKEIGFTVLDDTTNGAWVRNITVQSLWDQKVRG

SEQ ID NO: 275 - protein, 802 aa, Aspergillus nidulans
MRSLISVAVLSALAAFSQANTSYTDYNVEANPDLFPLCLQHLNASFPDCATGPLSLTPVCDRSLSPKDRATALVSLFTFDELVNNTGNTGLGVSRLGLPNYQVWGEALHGVGRANFVESGNFSWATSFPMPITMMAALNKTLIHQIGTIVSTQLRAFSNAGLGGVDVYSPNINTFRHPVWGRGQETPGEDAFLTSVYGYEYITALQGAVDPETSKIIATAKHYAGYDIESWNNHSRLGNDMQITQQELSEYYTPPFIVASRDAKVRSVMCSYNAVNGVPSCANKFFLQTLLRDTFEFSEDGYVSGDCGAVYNVWNPHGYASNEAAASADSILAGTDIDCGTSYQWHSEDAFEDSLVSRSDIERGVIRLYSNLVQAGYFDGEDAPYRDITWDDVLSTDAWNIAYEAAVEGIVLLKNDETLPLSKDIKSVAVIGPWANVTEELQGNYFGPAPYLISPLTGFRDSGLDVHYALGTNLTSHSTSGFEEALTAAKQADAIIFAGGIDNTIEAEAMDRENITWPGNQLDLISKLSELGKPLVVLQMGGGQVDSSSLKDNDNVNALIWGGYPGQSGGHALADIITGKRAPAGRLVTTQYPAEYAEVFPAIDMNLRPNETSGNPGQTYMWYTGTPVYEFGHGLFYTTFEESTETTDAGSFNIQTVLTTPHSGYEHAQQKTLLNFTATVKNTGERESDYTALVYVNTTAGPAPYPKKWVVGFDRLGGLEPGDSQTLTVPVTVESVARTDEQGNRVLYPGSYDVALNNERSVVVKFELKGEEAVILSWPEDTTSDFVSSIDGGLDRKQDVIA

SEQ ID NO: 276 - protein, 328 aa, Cochliobolus carbonum
MSVQAYDPPLISTFHQCDPAAHVWKHDPNTVYIYGSHDWNSTRQPPVQYDMKDYYVLTQTDYTKPATVGPKLLDLVDIPWATQQLWAPDATEKDGQYYLFFPAKDKDDVFRIGVAKSDKPDGKFKPEPNPIAGTYSIDPTILEDNGNYYMVWGGLWGGQLQAWTNNVLNTSLFGNNAPTSGPAIGPRFAKLSANLTSLATTPKELVIYDQDGKVMQAGSTRRFFEGPSLNKVGNLYVLQYSTGTSHTVEIATATKPDGPYYWKSTLLQPVKGWTTHESIVKFKNDWLLYYADASLSGRDDLRNTKVRKILFENGTFKLAQPQPVIPSS

SEQ ID NO: 277 - protein, 335 aa, Penicillium herquei
MDPKPLITHLYTADPSAHVFNGKLYIYPSHDRETDIAFNDNGDQYDMTDYHVFSMDSIDGPVEDSGVVLSAKDVPWVSKQMWAPDAATKNGKYYLVFPARDQEGIFRIGVAISDSPTGPFAPEKNYIPGSYSIDPAVFVDEDEKPYLYFGGIWGGQLQCWEKSGSEVKEGDEMNGLVFNASKSGPQEPSGDGVPALCPRVGQLSDDMLTFVSPPQELQILAPETGEPIAADDHERRFFEAAWMHRYNGQYYFSYSTGDSHYLVYATGSSPLGPFTYQGRILEPVLGWTTHHSIVEFQGKWYLFFHDCELSGGVNHLRSVKVREIVYDAEGKIHLA

SEQ ID NO: 278 - protein, 331 aa, Pyrenophora tritici-repentis
MSVAVYDPPVINTFHQCDPAAHVWKHDPNTVYVYGSHDVNSTKNPPVQYDMKDYYVLIQVDITKPATVGPKILDLPDIPWASQQLWAPDVAEKNGEYFLYFPAKDKDGVFRIGVAKSDKPDGKFKAEPSYIPGAYSIDPAILADDDGCYYMYFGGLWGGQLQAWPNNTLNTSAFGNISPSSGPALGPRFAKLSANMTHLATEPKELVIYDKDGQVMQANSTRRYFEAPSINKVGNLYYLQYSTGTSHTIEIAVGKKPEGPFYWKSTLLQPVKGWTTHESIVKFKGDWLLYYADASLTGIDDLRNTKVRKLNFANGTFALAQPQPYTPFPSS

SEQ ID NO: 279 - protein, 377 aa, Aspergillus aculeatus
MKLSHMLLSLASLGVATALPRTPNHNAATTAFPSTSGLHFTIDGKTGYFAGTNSYWIGFLTNNDDVDLVMSQLAASDLKILRVWGFNDVNTKPTDGTVWYQLHANGTSTINTGADGLQRLDYVVTSAEKYGVKLIINFVNEWTDYGGMQAYVTAYGAAAQTDFYTNTAIQAAYKNYIKAVVSRYSSSAAIFAWELANEPRCQGCDTSVLYNWISDTSKYIKSLDSKHLVTIGDEGFGLDVDSDGSYPYTYGEGLNFTKNLGISTIDFGTLHLYPDSWGTSYDWGNGWITAHAAACKAVGKPCLLEEYGVTSNHCAVESPWQQTAGNATGISGDLYWQYGTTFSWGQSPNDGNTFYYNTSDFTCLVTDHVAAINAQSK

SEQ ID NO: 280 - protein, 931 aa, Aspergillus niger; identical to SEQ ID NO: 274

SEQ ID NO: 281 - protein, 937 aa, Aspergillus aculeatus
MRALPTTATTLLGVLFFPSASRSQYVRDLGTEQWTLSSATLNRTVPAQFPSQVHMDLLREGIIDEPYNDLNDFNLRWIADANWTYTSGKIEGLGEDYESTWLVFDGLDTFASISFCGQFVGATDNQFRQYMFDVSSILKACPEEPTLGIQFGSAPNIVDAIAQDPSSPTWPEGVQITYEYPNRWFMRKEQSDFGWDWGPAFAPAGPWKPGYVVQLKQAAPVYVRNTDLDIYRLGQINYLPPDQTQPWVVNASLDYLGSLPENPSMAIEVKDLQSGEILASRPLTNITVTEGSVTGVTVLEGVDPKLWWPQGLGDQNLYNVTISVTDGGNQSVAEVTKRTGFRTIFLNQRNITDAQLAQGIAPGANWHFEVNGHEFYAKGSNLIPPDCFWTRVTEDTMTRLFDAVVAGNQNMLRVWSSGAYLHDYIYDLADEKGILLCSEFQFSDALYPTDDAFLENVAAEVVYNVRRVNHHPSLALWAGGNEIESLMLLLVEAADPESYPFYVGEYEKMYISLFLPLVYENTRSISYSPSSTTEGYLDIDLSAPVPMAERYSNTTEGEYYGDTDHYNYDASIAFDYGTYPVGRFANEFGFHSMPSLQTWQQALTDPADLTFNSSVVMLRNHHYPAGGLMTDNYHNTVARHGRNDPGRAGLLPDAQHSVRPRGQLQRLVPRDPALPGGPLQVTNPVLPAGQRAARTPARVPVLAARGHLAGALVGGDRVRRPLEGPHYVARDIYKPVIVSPFWNYTTGALDIYVTSDLWTAAAGSVTLTWRDLSGKPIASNGGLPTKPLPFHVGALNSTRLYRMNMKQQPLPRHEDAILALELTATGSLPNTDEEVTFTHEQWFTPAFPKDLDLVNLRVRVEYDAPLGKFAVEATAGVALYTWLEHPEGVVGYFEENSFVVVPGQKKVVGFVVQADETDGEWVHDVTVRSLWDLNEGE

SEQ ID NO: 282 - protein, 930 aa, Neosartorya fischeri
MHVKAETVLALLTPGLPSVVGQHVVDLSGDGWTLSSTALDRTVPGHLPSQVHLDLFEAGVINITASMILTFVGLLMPIGRIPATRLKACDLENFESTWLVFDGLDTFTTITFCDQHVGSTDNQFRQYHFDVSQILKECKQDPVIRINFGSAPSIANAIAKSPDAEEWPPGVQITNEYPNRWYIRKEQSDFGWDWGPAFAPVGPWKPSYIVQNNHAELYVLNTDLDFYRQGQINYLPPDQSQPWIVNASIDILGPVPWKPSMSIEIKDAATGSVLSSGLLQNVTVSGNSITGTTTIDGDAPKLWWPSGMGEQNLYNVTVTVQNDKKKSLAKVTKRTGFRTIFLNQRNITDDQLAQGIAPGANWHFEINGHAFYAKGSNIIPPDAFWPRVTQARMARLFDAVTAGNQNMLRVWASGAYLHDFIYDLADEKGILLWSEFQFSDALYPVNDAFLENVAAEVVYNVRRVNHHPSLALWAGGNEIESLMLPMVKRADPTGYSKYVGEYEKLYISLILPLVYENTRSITYSPSSTTEGYLYVNLSAPVPMAERYSNTTPGSYYGDTDYYNYDTSVSFDYNHYPVGRFANEFGFHSMPSLQTWQQAVDPEDLHFNSSVVMLRNHHYTAGGLFTDNFKNSSKGMGEMTMGVEAYYPIPSKSDSVANFSAWCHATQLFQADMYKSQIQFYRRGSGMPERQLGSLYWQLEDIWQAPTWAGIEYDGRWKVLHYVARDIYQPIIVSPFWNYTTGRLEVYVTSDLWEPAQGTVNLTWVDLSGKTIANNAGTPETVNFTVGALNTTNIYTTNISELSLPDLKDSILILSLSGEGRLPNTSSKKAFVHQNHFTPVFPKDLSLKDPKLEISYSPESRKFTVQATGGVSLYTWLDYPAGAVGYFEENAFVLLPGVQKEVSFAAQEGNVTDDWVRRVTVQSLWDQKVRD

SEQ ID NO: 283 - protein, 847 aa, Trichoderma reesei
MVIRSLLLLLLAAIVPVFAESGIDAWLRYARLPSSATRGHLTSFPDRIVVLNASKNGPLASASSELHKGIKGILGLDLDVSSRGGKHCSTQKSIVISTLDTYQSACGKLSPKLNLKEDGYWLSTKGGSVQIIGQNERGALYGAFQYLSYLGQGDFSGKAFASNPSAPVRWSNQWDNLNAATAAHGSIERGYGGPSIFFENGLIKEDLSRVPLYGRLLASVGLNGIVINNVNADANLLNETNLQGLKRIADLFRPWGVNVGISLNFASPQVLGDLSTFDPLDDSVIKWWTDKTDRIYQLVPDLAGYLVKANSEGQPGPLTYNRTLAEGANLFAKAVQPHGGIVVFRAFVYDQLNETDWKADRANAAVDFFKSLDGQFDDNVLVQIKYGPIDFQVREPASPLFANLPKTAVSIELEVTQEYLGQQSHLVYLPPLWQTVLGFDMRYNNRQSYVRDIISGEVFGHKLGGYAGVINVGMDDTWLGSHLAMSNMFAYGRLAWNPRADSRDIVEEWTRLTFGLDRDVVSTIADMSLKSWPAYEGYSGNLGIQTLTDILYTHYGANPASQDNNGWGQWTRADSKTIGMDRTVSNGTGNAGQYPKEVAARFEHTQTTPDDLMLWFHHVPYTFRLHSGKSVIQHFYDAHYTGAATVQRFPAAWKSLKSKIDTERYNAVLYKLQYQTGHSLVWRDAITEFYRNLSSIPDQLNRVRNHPHRIEAEDMDLSGFTVVNVSPTECASKYKAIATNGTGTATTRLNVPSGKYTVAVNYYDVINGTASYDVLLNGKSLGKWKGDSETHLGHDFSTFLDCHSAIRITFEGVRISRGDKLTIRGTGNAQEQAAIDYVSILPQGVVD

SEQ ID NO: 284 - protein, 841 aa, Aspergillus niger
MRGLNLFQLILALLLSMVAAEDGYDGWLRYAPVSCDLRCRQALPSHVVLLNSTKGSPIETAGRELKAGFQSILSTNLTSRPFQCNSSTSILVATLDEYRQRCRDINVPELDPDGFWLQSEGDTVRILGKDARGALYGAYEYLAMVAQRNFSRVAYATSPHAPIRWVNQWDNMDGSIERGYGGASIFFKDGTVVEDMAPVEQYARLLASIRINAIVVNNVNANATLLLPENMKGLGRIADACRPYGVQIGISLNFASPEDLGGLNTYDPLDPGVIAWWQNITDSLYTYVPDMAGYLVKADSEGQPGPDTYNRTLSQGANLFARALQPYGGVLMYRAFVYDDNLNESDWKADRAKAAVEYFKDLDGQFEENVVIQIKYGPIDFQVREPTSPLFANLYHTNTAIELEVSQEYLGQQCHLVYLPPLWKTVLDFDLRVDHKPSMVRDIISGQRFNRTLGGWAAVVNVGTNRTWLGSHLAMSNLYAYGRLAWSPTDESEQILEDWTRLTFGQNHHVINTISDMSMTSWPAYENYTGNLGIQTLTDILYTHYGPNPATQDNNGWGQWTRADHDSVGMDRTIRNGTGYTGQYPEEVARVYESLESTPDDLVLWFHHVPWTHRLHSGVTVIQHFYNAHYAGAEAAHGFVRQWESLEGLIDRERYEAMRSRLVYQAGHSIVWRDAINNFYYNMTGIPDVAGRVGHHPWRIEAESMRLDGYQTYTVSPFEAASNTTAIITTSNSTTGTARTSIKAPSGVYDIGVNYYDLYGGQSKWTLSVGDKVVGQWLGDMEHNSLGHTPSIYLDGHSATRITFHGVGIRQGDQLKIVGEANGVEPAPLDYIVLLPPGLVD

SEQ ID NO: 285 - protein, 837 aa, Talaromyces emersonii
MMRRLLLLLSAGLVAAENGLDGWLRYAPLPGASRYLHDLPSSIVALNASETSPVLVAGTELRRGLQGIFGKHVSISHQDCNASSSIVVGTVDEYSKLCGSTAALPELDQDGFLLNTKGNTVQISAVTSAVRSMAGAFEYLSMLAQGNFSQVAYASNPRAPIRWVNQWDNLDGSIERGYGGASIFFENGSVVSNLTRAAQYARLLASIGVNAVVVNNVNANASILTADNIDGLGRIADVFRPYGVQLAISLNFASPTIIGGLNTFDPLDPSVIAWWTNVTDNFTAHPDMAGYPVKADSEGQPGPLTYNRTLAKEPPFFAKVLQPHGGMVMFRALVYNQLNESDWKADRAKAAVDFFQGLDGQFDDNVVVQIKYGPIDFQVREPTPPLFAHLRNTSTAIELEVTQEYLGQQCHLVYLPPLLEDRPSALTSGVNQESRRLVRNIITGQRFNRTLGGAAAVVNVGTNTTWLGSHLAMSNLYAYGRLAWDPASDAERVLQDWIRLTFGQDRSVIDTITQMSMESWPAYENYSGNLGIQTLTDILYTHFGPNPASQDNNGWGQWTRADHTTIGMDRTVWNGTGYTGQYPPEVAAMYENIDTTPDDLLLWFHHVNYTHRLHSGKTVIQHFYDAHYRGAETAQTFLTMWEALKGKIDSERYNDVHFRLTYQAGHSIVWRDAITNFYFNLSGIPDEAGRVDHHPWRVEAESMTLSGCKTYAVSPFETAFNTTAIVTSTNSTVGTATTKLDYRLHVRPGRELLRHVRGQVHLAGVLNDRKSANGSGNKEEHFGHTPSIYLDGHSATRITFRGVKIGKGDELKIVGTPDGVEPAPLDYVAVLPGGVVD

SEQ ID NO: 286 - protein, 304 aa, Aspergillus niger
MLSTHLLFLATTLLTSLFHPIAAHVAKRSGSLQQITDFGDNPTGVGMYIYVPNNLASNPGIVVAIHYCTGTGPGYYSNSFYATLSEQYGFIVIYPSSPYSGGCWDVSSQATLTHNGGGNSNSIANMVTWTISEYGADSKKVFVTGSSSGAMMTNVMAATYPELFAAGTVYSGVSAGCFYSDTNQVDGWNSTCAQGDVITTPEHWASIAEAMYPGYSGSRPKMQIYHGSVDTTLYPQNYYETCKQWAGVFGYDYSAPESTEANTPQTNYETTIWGDNLQGIFATGVGHTVPIHGDKDMEWFGFAL

SEQ ID NO: 287 - protein, 302 aa, Trichoderma reesei
MPSVKETLTLLLSQAFLATGSPVDGETVVKRQCPAIHVFGARETTVSQGYGSSATVVNLVIQAHPGTTSEAIVYPACGGQASCGGISYANSVVNGTNAAAAAINNFHNSCPDTQLVLVGYSQGAQIFDNALCGGGDPGEGITNTAVPLTAGAVSAVKAAIFMGDPRNIHGLPYNVGTCTTQGFDARPAGFVCPSASKIKSYCDAADPYCCTGNDPNVHQGYGQEYGQQALAFINSQLSSGGSQPPGGGPTSTSRPTSTRTGSSPGPTQTHWGQCGGQGWTGPTQCESGTTCQVISQWYSQCL

SEQ ID NO: 288 - protein, 368 aa, Neosartorya fischeri
MRALSVFFALFCFLALSSASPGQDVVKRVTSGSLQQVTNFGSNPSGTLMYIYVPKNLATKPGIVVAIHYCTGTAQAYYTGSPYAQLAEQYGFIVIYPQSPYSGTCWDVSSQSALTHNGGGDSNSIANMVTWTISQYNADTSKVFVTGSSSGAMMTNVMAATYPELFAAATVYSGVSAGCFYSSSNQVDAWNSSCAQGNVISTPEVWGGIAKAMYPGYTGPRPRMQIYHGSTDTTLYPQNYYETCKQWAGVFGYNYNSPQSTQSNTPQANYQTTIWGPNLQGIFATGVGHTVPIHGEQDMEWFGFAGGSSTTTTQPTTTSTTTSSGGSSTGTGVAAHWGQCGGNGWTGPTVCASGYTCTVVNAWYSQCL

SEQ ID NO: 289 - protein, 444 aa, Trichoderma reesei
MTPHSIDRAARPSVWSGLALLLSTAHAIVMPDGVTGKVPSLGWNSWNAYHCDIDESKFLSAAEVIVSSGLLDAGYNYVNIDDCWSMKDGRVDGHIAVNTTRFPDGIDGLAKKVHDLGLKLGIYSTAGTATCAGYPASLGYEDVDAADFADWGVDYLKYDNCNVPSDWQDEYVACAPDAVQTGPNGTCSTALEPNLAPPGYDWSTSKSAERFNAMRNALAKQSREIVLSLCIWGVADVFSWGNETGISWRMSGDISPEWGSVTHIINMNSFKMNSVGFWGHNDADILEVGNGNLTAAETRTHFALWAAMKSPLLIGTDLAQLSQENIELLKNKHLLAFNQDSVYGQPATPYKWGVNPDWTFNYTNPAEYWAGPSSKGHLVLMMNTLDHTVRKEAKWSEIPGLSAGRYEVRDVWTDKSLGCLSSYKTAVAAHDTAVILVGKKCRNW

SEQ ID NO: 290 - protein, 499 aa, Aspergillus niger
MFSRRNLVALGLAATVSAGPCDIYEAGDTPCVAGHSTTRALYSSFSGALYQIKRGSDDTTTTISPLTAGGVADASAQDTFCANTTCLITIIYDQTGNGNHLTQAPPGGFDGPDTDGYDNLAPTIGAPVTLNGQKAYGVFMSPGTGYRNNAATGTATGHEAERMYAVLDGTHYNDACCFDYGNWQTSSTDTGAGHMEAIYFGTSTTWGYGAGDGPWLMVDMENNLFSGADEGYNSGDPSIPYTFLTAAVKGGADKWAIRGGNSASGSLSTYYSGVRPDYSGYNPMSKEGAIILGIGGDNSNGAQGTFYEGVMTSGYPSDATENSVQENIVAAKYAVGSLVSGPSFTSGEVVSLRVTTPGYTTRYIAHTDTTVNTQVVDDDSDSSLKEEASWTVVHGLANSQCFSFESVDTPGSYIRHYNFALLLNANDGTKQFHEDATFCPQAALNGEGTSLRSWSYPTRYFRHYENVLYAASNGGVQTFDSTTSFNNDVSFEIETAFAS

SEQ ID NO: 291 - protein, 322 aa, Trichoderma reesei
MELKALSAVVLSFVTLVAAAPATCTLPSTYRWNSTGALASPKSGWVSLKDFSHVIYNGQHLVWGSTHDTGTIWGSMNFGLFSDWSNMATASQNKMTPGTVAPTVFYFAPKNIWVLAYQWGPTTFSYLTSSNPSSVNGWSSPQPLFSGSISGSSPLDQTVIGDSTNMYLFFAGDDGKIYRASMPIGNFPGSFGSTSTVVLSDERNNLFEAVQVYTVSGQKQYLMIVEAIGANGRYFRSFTATNLGGTWTPQATSESQPFAGKANSGATWTNDISHGDLIRSNPDQTMTIDPCNLQFLYQGRATNSGGDYGLLPYRPGLLTLQR

SEQ ID NO: 292 - protein, 380 aa, Chaetomium globosum
MKLSKSDLSAALLASALPVAQAACSLPSSYKWTSTGALAQPRSGWANLKDFTYAPYNGKHLVYASYFGGNYGSMNFGLFSDWSSMGSASQNQMNSATVAPTLFYFAPKKVWVLAYQWGATPFSYRTSSDPTNPNGWSSAQPLFSGSISGSDTGPIDQTLISDGTNMYLFFAGDNGKIYRSSMPVGNFPGNFGSSSTVIMSGNKNDLFEAVQVYTVAGQSQKTYLMIIESIGSRGRYFRSYTSNNLGGSWTPQATSENAPFAGKANSGASWTNDISHGDLLRTSADETMTIDPCNLQLLYQGRSGDSSDYNSLPYRPGLLTLQGATGGSPNNPEPTGGTNPGTGGTVPKYGQCGGSGYTGPTTCASGSKCTFSNEWYSQCL

SEQ ID NO: 293 - protein, 332 aa, Aspergillus niger
MKFLKAKGSLLSSGIYLIALAPFVNAKCALPSTYSWTSTDALATPKSGWTALKDFTDVVSNGKHIVYASTTDTQGNYGSMGFGAFSDWSDMASASQTATSFSAVAPTLFYFQPKSIWVLAYQWGSSTFTYRTSQDPTNVNGWSSEQALFTGKISGSSTGAIDQTVIGDDTNMYLFFAGDNGKIYRSSMSINDFPGSFGSQYEEILSGATNDLFEAVQVYTVDGGEGDSKYLMIVEAIGSTGHRYFRSFTASSLGGEWTAQAASEDQPFAGKANSGATWTDDISHGDLVRNNPDQTMTVDPCNLQLLYQGHDPNSNSDYNLLPWKPGVLTLKQ

SEQ ID NO: 294 - protein, 499 aa, Penicillium decumbens
MAQLSFLTLAVLGLSGTVAAQSACASAWAQCGGSNFNGPTCCVSGSSCSVLNPYYSQCVPGTQVPGSGSGSSSTRSSSTTTAGGTGPSTTATAGGGAAGTSKYTTSTSFPAATATQPAYPSADPSSCGAWTLVDNVCCPEYCLSNNKSESCTSSCSGGCGTPPSSMCKSGTMWGEQLEVGTDEDWHYSRSTHFGLTSGGACGFGLYGPCTKGSKTASWTDPMLGSTCDAFCTAYPLLCKDPSDVTLRGNFAAPNGDYYTQFWPSLIGALPGSPDNYLSCGECFELIRTRADGTEYQVGDSGYTDPIYLEVVDSCPCSANSKWCCGSGADHCGEIDFKYGCPLPEGSHHMDLSDIAMGRLQGNGSLTDGVIPIRYRRVPCPKPGNAYVWLRDGGSEYYFALSVVNTNGVGSITTVEVKGKGSNSWVALKRDPNYTSSRPQERYGAWVIPQGKGPFSLPVGIRVTSPDGQQIVNENAITSFTAPAGSVEGFYYIDLGVQFT

SEQ ID NO: 295 - protein, 479 aa, Neosartorya fischeri
MMLLLGIFLAWLAVAAAQSSCVSAWGQCGGISYTGSTCCQSGNTCAEINSYYYQCTPATAVSTSTITGTSPSSPGSSSANTSGYTTTTVFPSPTATQNPYPPANASSCGSWALVDNVCCPYYCLSNNESESCTSSCTGGCGSPDSSMCKSGTMWGEQGTVTSNEDWHYSRSTHFGLTSGGACGFGLYGLCTKNSVTASWTDPMLGSTCDAFCTAYPLLCKDPANVTLRGNFAAPNGDYYTQFWPSLAASGNPDNYLSCGECFELIRTKPDGTDYAVGESGYTDPIVLEVVDSCPCDANSKWCCGSGADHCGEIDFKYGCPLPEGSHHMDLSDIAMGRLQGNGSLTDGVIPIRYRRVPCPKPGNIYIWLHDGAGQYYFALSAVNTNGPGSVISIEVQAGGSGPWIALEHDPNYTSSRPQERYGSWVLPQGKGPITAPVAMRLTAPDGQQVVKEGAITSFTPPATAVKGFWYIDLGVQFTR

SEQ ID NO: 296 - protein, 483 aa, Talaromyces stipitatus
MATTLIFVMGLWSGLLWSTTVAQASCAAIWAQCGGSGFSGPSCCETGSTCTQLNSFYSQCTPTTQISSASPTGTNPSSVTSLVPSGSSYTSTTSLSTATATQVPYPAVNSSSCGAWALVENVCCPYYCTSNNESESCTSSCSGGCGSPDASMCKSGTMWGEQTTVGTDESWHYSRSTHFGLTSGGACGFGLYGLCTKGSSTANWTDPMLGDTCNAFCTAYPLLCRDPSNVTLRGNFAAPNGDYYTQFWPSLAAEGNPDNYLSCGECFELIRTKADGTDYTVGEDGYTDPIYLEIVDSCPCSANAKWCCGSGADHCGEIDFKYGCPIPKDSHHMDLSDIAMGRLQGNGSLADGVIPIRYKRVPCPKPGNVYIWLRDGAGPYYFSLSAVNTNGVGSVINVEVQGSGQTGWTALERDPNYSSSRPQERYGAWVVPQGAGPFNVPIGIRITSPDGQQIVNTEMITSFTAPASAPSGFWYIDMGVQFT

SEQ ID NO: 297 - protein, 495 aa, Trichoderma reesei
MRFPSIFTAVLFAASSSLAQQNCAALFGQCGGIGWSGTTCCVAGAQCSFVNDWYSQCLASTGGNPPNGTTSSSLVSRTSSASSSVGSSSPGGNSPTGSASTYTTTDTAYVAPHSQSPYPSIAASSCGSWTLVDNVCCPSYCANDDTSESCSGCGTCTTPPSADCKSGTMYPEVHHVSSNESWHYSRSTHFGLTSGGACGFGLYGLCTKGSVTASWTDPMLGATCDAFCTAYPLLCKDPTGTTLRGNFAAPNGDYYTQFWSSLPGALDNYLSCGECIELIQTKPDGTDYAVGEAGYTDPITLEIVDSCPCSANSKWCCGPGADHCGEIDFKYGCPLPADSIHLDLSDIAMGRLQGNGSLTNGVIPTRYRRVQCPKVGNAYIWLRNGGGPYYFALTAVNTNGPGSVTKIEIKGADTDNWVALVHDPNYTSSRPQERYGSWVIPQGSGPFNLPVGIRLTSPTGEQIVNEQAIKTFTPPATGDPNFYYIDIGVQFSQNL

SEQ ID NO: 298 - protein, 316 aa, Trichoderma reesei
MVRRTALLALGALSTLSMAQISDDFESGWDQTKWPISAPDCNQGGTVSLDTTVAHSGSNSMKVVGGPNGYCGHIFFGTTQVPTGDVYVRAWIRLQTALGSNHVTFIIMPDTAQGGKHLRIGGQSQVLDYNRESDDATLPDLSPNGIASTVTLPTGAFQCFEYHLGTDGTIETWLNGSLIPGMTVGPGVDNPNDAGWTRASYIPEITGVNFGWEAYSGDVNTVWFDDISIASTRVGCGPGSPGGPGSSTTGRSSTSGPTSTSRPSTTIPPPTSRTTTATGPTQTHYGQCGGIGYSGPTVCASGTTCQVLNPYYSQCL

SEQ ID NO: 299 - protein, 308 aa, Chaetomium globosum
MLRQTALLALALVPATFAQVAEDFEGWDQTAWPIYAPDCNQGGKVSLDSTTAHSGKNSIRVDGAGGYCGHVFFGTNKVPSGDFYVRTYLKASKALTSSHVSFITMPDPAQGTNKHLRIGGQNSILMYNRESDDATLPDLSPQGVAASTALPTGSWQCFEYHVGSDGSIETWLNGQAIAGLTSIPGQSNPNAGQWQRSSIKPKPSAVYFGWESYGGDTNTFWYDDIVISSSRVGCSGGTNPPASTTLVTSVTPGPSSTATSLAPATSTTSSGCAAAQWSQCGGIGFNGCTTCASPYTCKFSNDYYSQCL

SEQ ID NO: 300 - protein, 315 aa, Magnaporthe grisea
MLRNITLALAAVLPFAMGQVSEGFEAGLDATAWPTYAPDCSQGGKITLDSSQAHTGKNSVRVDGAGGYCGHIFFGTTKVPSGDVYVRTWLKASRALTDAHVTFITMPDTAQGAKKHLRVGGQSKILMFNRETDDATLPDLSPQGIATSAALPANSWQCLEYHLGPDGTLETWLNDKAVAGLTSKAGVANPNAAQWQRSSIKPKVSGVYFGWESYGGDANTFWYDDVAISSQRVGCGNATVVEAYSSTTGRSSTSGPTSTSRPSTTIPPPTSRTTTATGPTQTHYGQCGGIGYSGPTVCASGTTCQVLNPYYSQCL

SEQ ID NO: 301 - protein, 460 aa, Trichoderma reesei
MASRFFALLLLAIPIQAQSPVWGQCGGIGWSGPTTCVGGATCVSYNPYYSQCIPSTQASSSIASTTLVTSFTTTTATRTSASTPPASSTGAGGATCSALPGSITLRSNAKLNDLFTMFNGDKVTTKDKFSCRQAEMSELIQRYELGTLPGRPSTLTASFSGNTLTINCGEAGKSISFTVTITYPSSGTAPYPAIIGYGGGSLPAPAGVAMINFNNDNIAAQVNTGSRGQGKFYDLYGSSHSAGAMTAWAWGVSRVIDALELVPGARIDTTKIGVTGCSRNGKGAMVAGAFEKRIVLTLPQESGAGGSACWRISDYLKSQGANIQTASEIIGEDPWFSTTFNSYVNQVPVLPFDHHSLAALIAPRGLFVIDNNIDWLGPQSCFGCMTAAHMAWQALGVSDHMGYSQIGAHAHCAFPSNQQSQLTAFVQKFLLGQSTNTAIFQSDFSANQSQWIDWTTPTLS

SEQ ID NO: 302 - protein, 474 aa, Chaetomium globosum
MLSPALASSLLVVLGAAGAHAQQRQALWGQCGGSGWNGPTACVDGAYCFQQNQWYHQCIPGSDRSPSPTNPPQQSSTLTTSRVTVAPPTSTSPAPGGGGTTCPATPSGQGSPVANALNDPFTFHGGGKVSSKADWTCRQAEISKLLQQYELGTLPPKPSSVTASFSGSTLSISVSEGGKSISFSVSINNRPSSSGPHPAIINFGTFGGLPVPAGVATINFNNDEIAQQQDQSSRGKGKFYDIYGSGHSAGALTAWAWGVSRIIDALELTRAQTNIDPARIGVTGCSRNGKGAMVAGALEPRIALTLPEESGAGGSGCWRIATWQKNRGENVQESKQIVTENVWFSTNFNSQVNNVNALPFDHHMLAGLIAPRALYVMENTDMEWLGKVSTYGCMGIARKQWEALGALDSFGYSQVGGNSHCSFPSSQQGSELNAFIGKYLLNNPNAGNTNIFRSTGNQNFDLNSWSPWTVPKLS

SEQ ID NO: 303 - protein, 390 aa, Aspergillus fumigatus
MFLYPVLLSLISSGALAATCPSLPSSPQLQSITTLPDPFSWYPLQKTGRVSTLSDWQCRQSHISSLLQQLELGTKPPAPSSVTSTFSQNKLTITATNAGNTISFTATITYPSSGEGPYPAMIAYGGLSIPLPPGVAAITFDNSQIAQQNDQSSRGQGLFYTLYGANHSAGALMAWAWATSLIIDRLEATPAARINTSRIGVTGCSRNGKGALVAGAFDSRIALTVPQESGTGGSGCWRLAAASEGAPQNVQTAGEIVQENVWFSTAFNAYANDEDRLPFDHHMLAGLIAPRGLLSIDNAGYQWLGPWSSLGCMGTARLVWQAMGVPDRMGYSMSTNHPHCSFPDQQREDLFAFINRFLLGMEVNTTVQKNYAGIAFDSKPWVNWQVPNLT

SEQ ID NO: 304 - protein, 494 aa, Populus alba
MANATTFSLMLQFFFVTFCCLSYFSFAFTSQDYANALEKPILFFEGQRSGKLPSNQRLAWRGDSGLSDGSTYHVNLVGGYYDAGDNVKFGLPMAFTTTLLAWSVIEFGSSMQNQIENAKAAIRWSTDYLLKAATATPDTLYVQVGNPNMDHRCWERPEDMDTPRNVYKVTIHNPGSDVAAETAAALAAASIVFKESDPSYSTKLLHTAMKVFDFADRYRGSYSNSLNSVVCPFYCSYSGYQDELLWGASWIHRASQNGSYLTYIQSNGHTMGSDDDDYSFSWDDKRPGTKILLSKEFLEKTTEEFQLYKSHSDNYICSLIPGTSSFQAQYTPGGLFYKASESNLQYVTSTTFLLLTYAKYLGSNGGVARCGGSTVTTESLIAQAKKQVDYILGDNPARMSYMVGFGNRYPQHVHHRGSSVPSIHAHPNRISCNDGFQFLYSSSPNPNVLVGAIIGGPDNRDNFADDRNNYQQSEPATYINAPFVGALAFFSAKN

SEQ ID NO: 305 - protein, 252 aa, Vitis lubrusca
MATAAFSSISLALFLFCLCLQGTNGDYGGWEGGHATFYGGGDASGTMGGACGYGNLYSQGYGTNTAALSTALFNSGLSCGACYEMKCNDDPKWCLPGTLTVTATNFCPPNLALSNTNGGWCNPPLQHFDLAEPAFLQIAQYPSWNRTCVFQRVPCVKKGGIRFTINGHSYFNLVLITNVAGAGDVRAVSIKGSKTGWQPMSRNWGQNWQSNSYLNGQTLSFQVTASDGRTMTSLNVAPAGWQFGQTYEGAQF

SEQ ID NO: 306 - protein, 264 aa, Triticum aestivum
MAPLSSKAVALVALFSLLVTYAAGAGNFNDSAFTADPNWEDARATWYGAPTGAGPDDDGGACGFKNTNQYPFSSMTSCGNEPIFKDGKGCGSCYQIRCTNDQSCSGNPETVVITDMNYYPVAKYHFDLSGTAFGAMAKPGLSEKLRHSGIIDIQFKRVPCEFPGLKVTFHVEQGSNPVYFAVLVEYEDGDGDVVQVDLMEANSGTWTPMRESWGSIWRLDSGHRLQAPFSMRITNESGKSLVADKVIPANWAPSTFYRSIVQYS

SEQ ID NO: 307 - protein, 229 aa, Eucalyptus globulus
MAKKLFITAALAAAVLAAPCGYGSGVAQAPFSSMVSAGGPSLFKSGKGCGACYQVKCTENAACSGNPVTVVITDECPGGPCVAESAHFDLSGTAFGAMASSGKADELRNAGVLQIQYQKVKCNFPGAKVAFHVDSGSNPNYFAALIEYEDGDGELGAVNLKQALDSDSWLPMQQSWGAVWKLDGAGQLRAPFSIKLTSLDSGKTLVANNVIPAGWQPGQTYRSVVNFAV

SEQ ID NO: 308 - protein, 281 aa, Aspergillus niger
MKQFSAKYALILLATAGQALAASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPAEQGYAHGGVEYWSVDPYSAQNTFVCTGDEVQCCEAQGGQGVNDAHTTYFGMTSGACTW

SEQ ID NO: 309 - protein, 338 aa, Aspergillus terreus
MKGAMLLAFSLTAVAQQTLYGQCGGSGWSGPTQCVSGACCMSQNPWYSQCLQGNCMTTTSVSTTRTTSVSVTTTTSTGSSPSSTSVSQGCGKSPTLSSGTHTMTVNGATRQYILTLPQGYDSSRPYKLIFGYHWLSGTMQNVVSGNYYGVQPLAGNSAIFVAPQGKNNGWANSGGEDITFTDQMLSTLQGDLCIDKTQIYSMGWSYGGSMSYALACARPNVFRGVAVMSGANLSGCSPGTQPVAYYAQHGVSDTVLSISLGRQIRDTFVKDNGCTAQNPPEPAAGSGTHIKSVYSGCSSGHPVWWIPFDGPHEPLATDRGASSSWTPGQIWDFISQFS

SEQ ID NO: 310 - protein, 358 aa, Talaromyces stipitatus
MAIPLVLLLAWLLPTVFAASLTQVSNFGDNPGSLQMYIYVPNNLASKPAIIVAMHPCGGSATQYYGMYDYHTPADQYGYILIYPSATRDLNCFDADTAASLTHNGGSDSLSIVNMVKYTISKYGADSSKVYMTGSSSGAIMTNVLAGTYPDVFAAGAAFSGMPFACLSGAGGADPAMSNQTCSRGQINHTPQEWAAYVHNAYPGYTGQYPRLQVWHGTADNVISYTDFNQEISQWTTVMGLSFTSNQTNTPLSGYTKMIYGDGSRFQAFSASGVGHFVPTDVSVVLDWFGITGGGGGNGGGSGSTTTTTSATTTSTGPTGGCTAAHWDQCGGNGYTGCTSCASPYTCQKVNDYYSQCL

SEQ ID NO: 311 - protein, 354 aa, Chaetomium globosum
MFLRTFLGLAATAATGLAASLQQVNSFGANPTNIQMFIYVPDKVAANPAIIVALHPCGGSGQQWFSGTRLPSYADSNGFIIVYPSTPHMSNCWDVQNPDSLTHGQGGDAGGIISMVNYTLEKYSGDRDRVYVMGFSSGGMMTNVMAGSYPDVFEAGAAYSGVAFGCFQGAPSATPMSPNQTCAQGMQKTPQEWGNLVRNAYPGYTGRRPRMQITHGLADGLVRPTCGEEALKQWSNVLGVEYTRDVAGVPSSGWTQKLYGGDGVKVQGFMGQGVGHAPSVNEEQLLTWFGILGGGENGGGENGGGNNGGGNNGGGGGGTVALWGQCGGNGYSGPTGCAQGTCKVLNEWYSQCTP

SEQ ID NO: 312 - protein, 741 aa, Streptomyces avermitilis
MTHRTGRAPEHGPRPGRRRRRTTSVAAALVTLALGLAGQLAGHPAAAAEAHADNPFAGASFYVNPDYTDLVGTSAAQTSDATLKARMQKVGTYPTAVWLDRIAAITGGAANAGRKSLADHLDLALAQKKPGQPITATFVVYDLPGRDCSALASNGELPLTQAGLDRYKSEYVDAIANVFKNPKYRDIRITTVIEPDGLPNLVTNTADPECAQAKSSGIYVKGIQYALDRLHAIPNVYTYLDFAHSGWLGWDNNLSQTVQLYTDVAKGTAAGFSSADGLITHVSNYTPLEEPFLTDPDKTVGGNMVKSSKFYEWNPNFDESDFTGNVHRALVAAGWPASTGMVIDTSRNGWGGTGRPTTESSSTTLDTYVNESRVDRRAHRGLWCNVSGAGLGQPPQAAPSGSPDSHLDAFLWIKPPGESDGASSDIPNDEGKRMDPMCDPTYTAPNAGGNKTGALPNAPLAGHWFAEQFAMLVRNAYPAVLTDGGGTPGGDTTAPTAPTGLKATAKTPSSVSLSWTASTDDTGVSGYDLYRGGTKVTASPVAGTAFTDTGLSAGTAYSYTVRARDAAGNVSAPSASLSVTTDTSGGTPDPSGGLKVLYKNNDSSATDNAIRPGLRIVNTGSGSLDLSKVTARYYFTRDSGSPTVNAWCDYAAVGCSNVSLKVVPLTTPVPGADAYLEVGFTGGTLAVGQNTGDLQLRMSKSDWSNFDEVGDYSRGTSTTYTEAAAIPAYLSATPAWGAPPA

SEQ ID NO: 313 - protein, 569 aa, Streptomyces avermitilis
MSRTRTAILAALALVAGASGTAVAAVAPEPGIAAVPCTVDYKVQNQWDTGFTTAVTVTNNGAAKSSWAVKWSYAGNQKVTSGWNARISQSGTAVTAANESYNGALASGGSVSFGFNASYSGTNALPTAFTLDGVTCNVDDGGGGGGGTDPDPSGKVDNPYAGAKVYVNPEWSAKAAAETGGSRISSQPTGVWLDRIAAINGVNGGMGLRAHLDAALAQKGSGEEVVQLVVYDLPGRDCAALASNGELGPTEIDKYKTQFIDPIAAILADSKYAGLRIVTTIEIDSLPNLVTNTGSRATATPACDTMLANGNYVKGVGYALNKLGAIPNVYNYLDAGHHGWIGWDDNFAPSATLFKQAATSEGATVDDVHGFITNTANYSALKENNFTINDSVNGTSVRQSKWVDWNRYVDELSFAQAFRTQLVSVGFNSGIGMLIDTSRNGWGGTARPTGPGATTSVDTYVNGGRYDRRIHVGNWCNQSGAGLGERPQAAPATGIDAYVWMKPPGESDGSSSAIANDEGKGFDRMCDPTYTGNARNGNSMSGALPNAPLSGHWFSAQFQELMKNAYPAL

SEQ ID NO: 314 - protein, 973 aa, Streptomyces avermitilis
MASRRRRRTVRRLWTAVVAALALPVTTLATGISAPSAQAAALQCSVDYKTNDWGSGFTTDVTVTNRGTDPINGWTLTYAYTGNQTLTGGWSGTWSQSGKSITVKNASYNGTIAAGAAVNTGAQFSYSGTNTSPTGFAVNGTTCAGAHQPPVTVLTSPTAGAVYTQGDAVPLVATAAAADNATISKIEFYDDTTLLGTDTSSPYTLSAAGLSVGGHSLIAKAYDSLGASAESTPVGITVASGPAVVASPTQLGVQQGKSGTFAVKLSTQPSANVTVGVTRTDGNTGLSVTGGSSLTFTPANWNTAQTVTITADASGTGSATFTALATGHTKATVTVTELAGSKAYDARFLDLYGKITNPANGYFSPEGIPYHSVETLIVEAPDQGHETTSEAYSYLLWLQAMYGKVTGDWSKFNGAWDLMEKYMIPTHADQPTNSFYNASKPATYAPELDTPGEYPAKLEPGVPAGSDPIASELKSAYGTDDVYGMHWLQDVDNVYGYGNEPGKCEAGPTATGPSYINTFQRGAQESVWETVPQPTCDAFKYGGTNGYLDLFTGDSSYAKQWKYTDAPDADARAVQAAYWADVWAKAQGKGGDVSGTVGKAAKMGDYLRYAMYDKYFKKIGNCVGPSTCAAGTGKDASHYLMSWYYAWGGATDTSAGWAWRIGSSHTHGGYQNPLAAYALSSYADLKPKSATGQADWAKSLDRQLEFYRWLQSSEGAIAGGATNSWAGRYATPPTGTPTFYGMYYDQQPVYHDPPSNQWFGFQAWSMERVAEYYQQTGNANAKAVLDKWVGWALSKTTINPDGTYRIPSTLQWSGSPDTWNASSPGANTGLHVTVADYTDDVGVAAAYAKTLTYYAARSGSTAAKTTAKALLDGMWNNYQDSLGVAVPETRTDYNRFDDSVYVPSGWTGKMPNGDAVNSSSTFTSLRSFYKNDPAWSKIESYLAGGAAPTFTYHRFWAQADIALAMGSYAELLE

SEQ ID NO: 315 - protein, 375 aa, Streptomyces avermitilis
MRPSPPHARSARGLFGALLTALVSLAALLTTASVAQADTSICEPFGSTTIQGRYVVQNNRWGTSEAQCITATDSGFRITQADGSVPTNGAPKSYPSVYNGCHYTNCSPGTSLPAQLSTVSSAPTSISYSYVSNAMYDAAYDIWLDPTPRTDGVNRTEIMVWFNKVGSVQPVGSQVGTATVAGRQWQVWSGNNGSNDVLSFVAPSAITSWSFDVMDFVRQAVSRGLAQNSWYLTSVQAGFEPWQNGAGLAVTSFSSTVNTGGGNPGDPGSPTACKVAYATNVWQGGFTADVTVTNTGSSPVNGWKLAFTLPAGQQITSSWSAGVSPSSGAVTASSLAYNAQIATGGRVSFGFQGSYSGTFAAPAGFSLNGAACTTA

SEQ ID NO: 316 - protein, 492 aa, Streptomyces avermitilis
MRHPPRSALLLVAGAVALIGSAVVPVVTASGATTPACTVEYAVTSQWDAGFQGGVKITNNMAALSSWRLTFDFAGGQKVTQGWNAKWSQSGTTVTAANESYNGSLGSGASVSAGFLASWSGSNAVPTSFKLNGTTCNVEAEPSPSPSPSDPPATGAAPKLHVSGNKLVDADGKTRRLLGVNRSGGEFMCVQGYGIFDGPVDDAAVKAIADWKANTVRIPLNEECWLGLSNIKPEYGGANYIAAVKDLVARVEAHGMTPVVELHWTYGQYTGNSAGCSDVHATCQKPMPDAQYTPSFWASVASTFKDDAAVAFDLFNEPYPDRATSTTTQAWQCWRDGGTCPGITYEVAGMQDLVDAVRGTGAKNLILAGGLAYSNDLSQWLTYKPTDATGNLVAAYHVYNFNTCASETCWNSTLAPVAAQVPLVAGEIGENTCSHSFIDTVMKWFDDRGLSYLGWTWNTWDCSSGPSLISNYDGTPTSFGIGLRDHLRALNG

SEQ ID NO: 317 - protein, 882 aa, Streptomyces avermitilis
MRRTRIFTAVLALAAGLPAGTPPALAASAPTATIAADTYSWKNARVDGGGFVPGIVFNRSEKNLAYARTDIGGAYRWAESSKTWTPLLDSVGWSDWGHTGVVSLASDSVDPNKVYAAVGTYTNSWDPGNGAVLRSGDRGASWQKTDLPFKLGGNMPGRGMGERLAVDPNRNSVLYLGAPSGKGLWRSTDSGASWSQVTDFPNVGTYVQDATDTSGYASDNQGIVWVTFDESTGSPGSSTRTVYVGVADKDNSVYRSTDAGATWSRLAGQPTGHLAHKGVLDAANGCLYLAYSDKGGPYDGGKGQLWRYTTKTGTWTNISPVAEADTYYGFSGLTVDRQHPGTVMATAYSSWWPDTQLFRSTDSGGTWTKAWDYTSYPSRSNRFTMDVSSSPWLTWGANPAPPEQTPKLGWMTESLEIDPFDSARMMYGTGATVYGTDNLTNWDSGSQFTIKPMARGLEETAVNDLASPPSGGAQLFSALGDIGGFRHTDLTTVPSLMYTSPNFTTSTSLDYAETDPGTVVRVGNLDSGPHVAFSTDNGANWFAGADPSGVSGGGTVAAASDGSRFVWSPAGTGVQYTTGFGTSWSASAGLPAGAIVESDRVDPKTFYGFKSGRFYVSSDGGATFTASAATGLPSGDSVRFKALPGTKGDIWLAGGASDGAYGLWHSTDGGAAFTKLATVDQADTIGFGKAATGASYQTLYTSAKIGGVRGIFRSTDKGASWTRVNDDAHQWGWTGAAITGDPRVYGRVYVSTNGRGIVYGDTAGSSDGGGTEPAPTGACTVTYRITNQWSGGFQADVQLANTGSTAWDGWSLGWSFGDGQEVTQLWNASYAQAGSGVTAANLAWNGRVAAGSSVSFGFTGSWSGSNGRPTAFKLGGQNCTVA

SEQ ID NO: 318 - protein, 269 aa, Streptomyces avermitilis
MQHRRPRLSKKARALVATTVVLAAAAGVTVAQAGETGKKCAAFDTITLGKYYVNNNLWGQDKATGTQCVWDDSRSGSTISWGTDYSWANNSAGHDYDVKSYASSVLGWHWGWKADKAATGLPVRVGDRKSVRTTWDFSVGAGPGTMNVAYDLWLHAKNNADWQDQPTDEIMVWLNRQGGAGPLGTKYGSVSLGGAMWDIYQGDIGWKVYSFVRRTNTTKATLDLDDFTQALVRRKLLSDDKYVSGIEAGTEVFKGAGRLDTKAYSVDIG

SEQ ID NO: 319 - protein, 338 aa, Streptomyces avermitilis
MYGKRGAGALAAVALAGAALLLAGCSAPEDNSKKGGGGADIAQRPKGSDPFWVNPEGNAAEQLATYARAGRKDDAEQIRKIAEQPTGEWIGPENPEAEARGYTEAAEKADRTALLVLYNIPHRDCGQFSQGGAADGDAYRAWIDGVTKGIGDRNTTVVLEPDALLHIVDGCTPDEFHEERYDLLKGAIAKLGALKNTKVYLDAGNAGWGHPDQIFQPLQRAGVDRADGFAVNVSNFYTTRDSIAYGKQLSAKVGDKHFVIDTSRNGNGPYTAGKADENWCNPPGRALGETPSTKTADPLVDAYVWVKRPGESDGTCKGGPKAGEWWSDYALKLARASK

SEQ ID NO: 320 - protein, 370 aa, Streptomyces avermitilis
MVAVASFVVAVGTATGMMSAFDDGRTPDQARPQVTGPPSRRPLPAVPSPSPATTSARPSPATPSAGPGPKSSPSKREPTTAAAPAQLYRHPESQVLDWVGAHPDDARRAVIESRIADRPAAVWFADFAPSTITARVRAVTAAAAAQDRVPVVVPYTIPDRDCGGASQGGAPDLAAYDAWIDKFAAGLGSGEVIVILEPDSVAQSDCLSEGRQADRFASLARAGRVLKAANPGVRVYFDGGHSEWNPAAKQASLLDQAGAASPAASDGIFTNVSNFHRTSDEIAYARQVLAGLGGPASLGAVIDTSRNGNGAPAGGEWCDPAGRKIGRAPTLTTGEAGIDAYLWVKLPGESDGCKGTPGTFSPAYAYELAR

SEQ ID NO: 321 - protein, 358 aa, Streptomyces avermitilis
MPHTTAAHRRRASRPLPLVAVGALVAAAVALPQLTPDAFAATTLRGYADGRGVRIGAAVGDSPLRSDSAYTTALDREFNSVTAENAMKWDAVEPSRGGFDWAAADRLVAHASAHGQGVRGHTLAWYAQLPSWLKNGNFSASELNTILKSHIDTEVGRYKGKVYAWDVVNETFNEDGSMRGSLWQDKLGTGYIANALRWAHAADPAAKLYINDYNIEADNAKSDALYALAKQLLADGVPLHGIGFQSHFVVGQVPSTMKANLKRFSDLGLEVSVTELDIRIPLPASSDELAQQSADYKTASENCLGVARCAGITVWGVSDKYSWIPGTFSGYGAALPYNESYAAKPAYTGLSNGLDPTA

SEQ ID NO: 322 - protein, 451 aa, Streptomyces avermitilis
MRSLKRSGLSPASLLTGIAALAALLAAAPAAHAADTPLRDLAAAKGKVIGTAVTGSKLTGTYGDIAGAQFNSLTPGNAMKWGSVEPTQGTYNWTEADQIVAFAQAHNQQVRGHTLVWHSQNPSWLTNGTWTPAQLGTLLQNHITTEVTRYQGKLAAWDVVNEPFNEDGTYRSTLWYNGLGSDYIAQALTAARAADPSAKLYINDYNVEGVNAKSTALYNLVKSLKDRGVPIDGVGLQAHLVLGQVPSTLQQNIQRFADLGVDVAITELDIRMQLPATDAKLTQQAADYKAVLDACVAVTRCVGVTVWGFTDSDSWIPDVFSGYGAATPYDENYAPKPAYHAIATALGGTSTPPTGACTATYSVTSQWNAGFTGQVRIACSGASLSAWKVSWTYGAGQQITQAWNATCTQSGTAVSCANASYNGTVPNGGSVTFGFNASWSGSNPLPTVTLG

SEQ ID NO: 323 - protein, 436 aa, Streptomyces avermitilis
MILTSDLGDGTYRTPVLNADWSDPDLLRVGDDFYLTASSFGRAPGLPLPHSRDLVNWRLVGHALPRLEPAHEFRTPRHDCGVWAPSLRHHYGWLWISAPAGGVQTGWQGAFRSPGFFGPYEERIVLEQGDTDVDGPHQGGWVRTPAGEDWFAHFQARGAYGRVVHLQLMRRGSDGWPVIGNEGVPVAVHRKPDLPRQPPSAPATDDDFPGGRFGRQWQWTANPLPSSRLRSSRGDPHDGWATQLSGDGLRLTCVRTADAHDLRKLPNVLTQRLPGAPATVEVELRLDSEEPGARAGLAVLGDAFSWIGLQRGRDGSVQLVHRFDESVAMGAPPTPSGQWGKERDAAHARLAPGGRARLWIEIGRGARCRFSYDTGDGRRPSGPVFAATPWRWVGALIGLVALAPVGAGHAGAATFTRFRGTAAGSASLSAPASTSA

SEQ ID NO: 324 - protein, 735 aa, Streptomyces avermitilis
MRRTARTLLVPLLALLLGLLAAPPSPAAQSGAPHVNAAKYAGYLFAYFTGEGTADGEQIRYALSRGNDPLHWRELNAGKPVLTSDLGEKGLRDPFVIRSPKGDKFFLIATDLKMYRNSSGSWDQVQRHGSRSIMIWESTDLVHWTDQRLVRVAPGNAGNTWAPEAYWDDTLGAYVVFWASKLYADDDPDHTGSTYNKMLYATTKDFRTFSEPKVWDDPGYSVIDSTVIKHKGSYYRYTKDERDPSSSSPCSKFITGEKSTSLTDPTYDFVSDCIGSGSIDRGEGPTVFKSNTENKWYLFIDEYGGRGYVPFETTDLDSGEWTMSTDYQLPASPRHGTVMPVTRAEYDRLLAAYPVSGTSVVDATAKGQKGYAVVSEDTAKVVLPMKPDADLRRLAPALAVGAGATLSPRSGTRRDFRRPQTYTVTAADGTRRTWTVEAVPTRSPVLPGLYADPDIQYLDGRYWIYPTTDGFPGWSGTRFKAFSSKDLVHWKDHGVILDLGPDVTWADKNAWAPAIAERDGKYYFYFCAEQQIGVAVADSPAGPFKDALGKPLVAKGKLAGQMIDPAVFTDDDGTSYLYWGNGHGYVVPLNDDMVSYDATKVKDITQPDFREGSFVVERQGTYYFMWSEDDTGSENYHVSYATGPSPLGPWTKRGTILSKRPEYGIKGTGHHSVVNVPGTDDWYIVYHRFALSGPGKAGGDGTHRETTIDRMTFAADGTIEPVTPTLESVRPVRAN

SEQ ID NO: 325 - protein, 507 aa, Streptomyces avermitilis
MISVPAEATGRLSDAWRACVGTGRIELALRRDYQDSLALLQREIGFRYIRGHGLLSDGMGVYRPYAYEGARRVHHSFTYVDQVVDAYLGLHVRPFLELGFMPTELASGDQTVFWWRGNVTPPRSYDEWARLVRATLTHLVDRYGIEEVRTWPIEVWNEPNLTDFWQGADEAEYHRLYEVTARTVKDVDASLQVGGPAISPGADEWLLRFAEFAERREVPVDFVSRHAYTSGPARPVPFGAYQTLAPARRLLDQFARPREQLKGTRYTELPVHITEFNSSYRPDNPIHDTAFHAAYLAPVLAAGGDHADSFSYWTFSDMFEESGVPTALFHGGFGLLTHRQVKKPTYHLYAFMARMGEELLERGDDHLVTRHPDGRVTVLAWAPVDETGRTPGPDRHTLRLSVPVGRRPRGAAFVRRSTVDEEHGNAWTAWRHMGGPRSPRPHQIDLLHEAAEPARSHLRLPVEDFRADLGLTLARHEVTLVELSPVEDETPPWWDERRLLGSPVEPR

SEQ ID NO: 326 - protein, 464 aa, Streptomyces avermitilis
MILFALCLAFAGALTTAGPARAAAQTLTNGTQFTDTSGNGVHAHGGGVIKVGGYYYWFGEDRNADNTFKYVDAYRSTDLKNWEFRSHVLTQAGASELASANIERPKVMYNASTGKFVMWMHKENGTDYSEARAAVAVSDTVDGTYTWQGSFQPLGQYMSRDITVFVDTDGTGYMVSAARENYDLQIYRLTADYTGIDSLVADPWHGGHREAPALFKRGGVYFMLTSGATGWNPNQQQYATATSLAGPWTAMTNVGDSTAYGSQTAYVLPVQGTSGTSYLYLGDRWGNSFGGSVNDSRYVWLPLTFPTSTSLSMSWYPEVTVDTVAGTISGTSATYETLTARHSAKCADVPSQSLLTGVALTQYTCNGGNNQKFWFKSVAGGYYELMGRGSSLCLTENVTAVTQENCTAATSQQWSLTTSGGYVSLKSRASGECLDVSGASTANSAALITYTCNGGTNQQWTRGT

SEQ ID NO: 327 - protein, 742 aa, Streptomyces avermitilis
MTHPWQDPALPAAVRAADLLARMTPQEKTAQLYGVWPGSDEAPGGDVAPLQHALSEGVDLAGLLPHGLGQLTRPFGTAPVDPAEGAARLGFLQERIRAANRFRLPALAHEECLTGFTAWQATIFPTPLAWGASFDPDLVKEMAAAIGASMRAVGVHQGLAPVLDVVRDPRWGRTEESIGEDPYLVATVGTAYVQGLQSSGVVATLKHLAGYSASRGARNHAPASLGPRELADVILPPFEMAVREGGARSVMAAYNDIDGLPAHAHHRLLTHLLRDEWQFTGTVVSDYFGVSFLESAHGLADSPAGAAALALAAGVDVELPAVRCFGAGPFDEELVDRAALRVLTQKCELGLLDPDWAPPATEAPVDLDPPHMRALARQLAQESVVLLANDRGLLPLAPGARRIAVLGPHADDPAAMLGCYTFPRHVLLDRPGVPMGVAVPTLLEALRTELPDAEFVTDPAAAEVCVVAVGDRSGLFGRGTSGEGCDAADLELPDGQGEVVDRALASGTPVVLVLLSGRPYALGRWADRCAAVVQAFFPGEEGGPAVAGVLSGRVNPSGRLPVSVPRGPAGQPWTYLAPPLGRHGEASNLDPTPLYPFGHGLSYTTYDWQAPSVDDASFPTDGETTLRLTVRNTGERPGTEVVQLYLHDPVGKVARPVVRLVGYARVPLEPGASGEVHFTVPADLAAYTGPDGERIVEPGALELRLGVSSADGDVRYTVPVTLTGPERVVGRERRLRCEVRVK

SEQ ID NO: 328 - protein, 421 aa, Streptomyces avermitilis
MHGTPAVPPKNTGPEVGWGFTHTQFSADEGSGDATQRVEGLLAQRAVPQIQHIMGWGAGNPEPVKGRYDFAEMDRRIDFIRESGGTPVVTLCCAPDWMKGGKSGADNTDWSRSALETAPDPDHYKDFAALAVTVAKRYPDVRHFIVWNEFKGFWNDSRARWDYEGYTELYNLVYKALKKVDEKNMVGGPYLVMDSVDPRQQENASTAVKGPWGAMDQRVLDAFDYWNRNKAGADFVVVDGSSYTKDDDLLPNEFAATDKLTAVGEWVRARTRGLPLWWAEYYVEPADGNDDRTGWSETRRVAVQATGMIAMARGGASSGFYWNPEEERGSDCAGCLWTPTSGGDGGTKLPMYDLVSRFGKEFPPGTTYETVPVAKDDVPNVRVLADDKAVLVVNTLDRAISAKVDGKRFELPAYGVKWLRR

SEQ ID NO: 329 - protein, 452 aa, Streptomyces avermitilis
MTIDLAALPHDFLWGTATAAYQIEGAVAEDGRSPSIWDTFSHTPGKIDNNDHGDVACDHYHRWREDIGLMKQLGTNAYRLSVAWPRVIPGGDGPVNAKGLAFYDELVDGLLEAGITPSVTLYHWDLPQVLQDRGGWPERATAEHFAAYAAVVAERLGDRVTHWATLNEPLCSAWIGHLEGKMAPGLTDLTAAIRASYHLLLGHGLAAQAIRAAAPAAEVGIVNNLSTIHAASDRPEDVAAARRMDGHVNRWWLDPVHGRGFPADMREVYGVELPEQPGDLATIAAPLDWLGLNYYFPATVADDPTGPAPRVRSVRRLGVPRTGMDWEIDATGIETLLLRLTHEYGPRKLYVTENGSAFPDVVRPDGTVDDPERQDYLVRHLAACASAARKGAPLAGYFAWSLLDNFEWAYGYDKRFGLVHVDYRTQVRTIKGTGHRYADIVRTHRGRARRAA

SEQ ID NO: 330 - protein, 482 aa, Streptomyces avermitilis
MASAETSAAPVSPVTFPPAFLWGAATSAYQIEGAVREDGRTPSIWDTFSHTPGKTAGGETGDIAVDHYHRYRDDVALMAELGLGAYRFSVSWSRVQPMGRGPAVQRGLDFYRRLVDELLAHGVKPALTLYHWDLPQELEDAGGWPERDTAYRFAEYAQIVGDALGDRVEQWITLNEPWCSAFLGYGSGVHAPGRTDAAASLRAAHHLNLAHGLGTSALRAAMPARNTVAVSLNSSVVRTVSDSPADVAAGRRIDDLANGVFHGPMLHGAYPAGLFAATASVTDWSFVQDGDLEAVNQPLDALGLNYYTPTLVSATESAPAGPRADGHGASSFSPWPGADDVVFHLTPGERTEMGWSIDPTGLHELIMRYTREAPGLPLYITENGAAYDDKPDPEGRVHDPERIAYLHGHLTAVRRAITDGADVRGYYLWSLMDNFEWAYGYGKRFGAVYVDYATLARTPKSSARWYAQAARTGTLPGATAAE

SEQ ID NO: 331 - protein, 441 aa, Streptomyces avermitilis
MIRRMATNPISQFPAGFLWGVSTSAHQIEGAADEREPSVWDAFTAEPGRVKDGSTAAVACDHYHRYAEDVALLADLGVDAYRFSVSWPRVNSPGGLDFYDRLVDELCAAGVRPVPTLFHWDLPLALDWLDRDTAARFAEYAARVAERLGDRVTKWITLNEPAEHTLLGHALGAHAPGRQLLFDALPAAHHQLLAHGLAVRALRAAGVTDIGIANSHGPTWPASQEPADLEAAAFYDLLLNRLFSDPLLLGRYPEGIGELMPKGSAGIESDLKVIAEPIDWYGINYYAPTKVGAPQGAEIEFGGLTLPAELPFSVREIEGHPVTDFGWPVVPQALTELLTGFRERFGDRLPPIVITENGCSYEGIDDQERIAYLDGHVRALHRAVEAGVDVRGYFVWSLLDNFEWAEGYERRFGLVHVDYDTLERTPKASYGWLRDALRARR

SEQ ID NO: 332 - protein, 322 aa, Streptomyces avermitilis
MALFDLPLDQLRGYRSASAEPEDFDAFWAKTLQEARQYDLGPRFEPVETHLETVEVYDVTFAGFDGHPVKGWLTLPARANAPLPTVVEFIGYGGGRGLPHTHLLWASAGFAHFVMDTRGQGSAWGGGDTPDPVGSGPAFPGFMTRGVEDPESYYYRRLFTDGVRAVEAARAHPLTDSARVAAVGTSQGGGITIAVGGLVPDLAAVAPDVPFLCDFPRATTLTDRDPYREIGRYLKTNRGRTEQVQRTLSYFDGVHFAARGSAPALFSAALEDQTCPPSTVFAAFNAWAHADKAIEVYDFNDHEGGGPYQEAAQLRWLPDRLR

SEQ ID NO: 333 - protein, 333 aa, Streptomyces avermitilis
MRGAVPAFDLPPAELENHRPAPHEPADFDAFWQATLKESGQAEPVLSVRPFDSGLRLVETWDVTFRGFAGDPVRAWYTRPAEAPRPLPAVVEYAGYGRGRGLPHERLTWAAAGYAHLLMDNRGQGDQYGCGGDTPDPHATAPSGPGPAVRGLLDPRDYHYRRLITDAVRAVAALRALPGVDGSRVAAVGNSQGGGLALAVAGLVPDLAAVLVSAPFLCGIRRALELTDAAPYGEITAYLAVHRGAEAAAYRTLSYVEGVSFARRATAPAHFGIGLRDTVCPPSGAYAAYNRYAELTGHDPLKEIHPYPFNQHEGGDAVHVRRQLTWLDGILGG

SEQ ID NO: 334 - protein, 481 aa, Streptomyces avermitilis
MRRLTVRLFTAVLAALALLTMGTPAHATAPASPSVTFTNPLAEKRADPHIFKHTDGYYYFTATVPEYDRIVLRRATTLQGLATAPETTIWTKHASGVMGAHIWAPEIHFIDGKWYVYFAAGSTSDVWAIRMYVLESGAANPLTGSWTEKGQIATPVSSFSLDATTFVVNGVRHLAWAQRNPAEDNNTSLFIAKMANPWTISGTPTEISQPTLSWETVGYKVNEGPAVIQHGGKVFLTYSASATDANYCLGMLSASASADLLNAASWTKSSQPVFKTSEATGQYGPGHNSFTVSEDGKSDILVYHDRNYKDISGDPLNDPNRRTRLQKVYWNADGTPNFGIPVADGVTPVRFSSYNYPDRYIRHWDFRARIEANVTNLADSQFRVVTGLAGSGTISLESANYPGYYLRHKNYEVWVEKNDGSSAFKNDASFSRRAGLADSADGIAFESYNYPGRYLRHYENLLRIQPVSTALDRQDATFYAE

SEQ ID NO: 335 - protein, 469 aa, Streptomyces avermitilis
MTVEDRGIPSDPPAPSRRGILRALLALPATALVWGEMPGAVGSAAAAAPSKGYATRYTIVPFLNSDDGVVNVYQSDDATDFRLLKATAYTPPSNRIRDASVFKHTNGYYYLTYTTHTWQDVSTTIGFARSSDRVNWTFLYDHTVPLTNLSRAWAPEWFVDSDGSVNVIVSCSATDNEWIFTPYLLKATNTGLTSWSAPVALSGIGANHIDTYIVKIGSTYHAFTKNETAKYIEYATATSLTGPYTISRTGDWAGWGSYREGPSVVRLDNGGWRIFFDGYGDGTYYFSDSYDTFATWTAPKALAGISGTARHFTVVKETVSGGVSLSTGVSRSFQSVNYPTRYWQEQSSLLNLPVVSSAASSAEKAASAFTVVAGLADAGGYSFRDAAGNYLRHYDYRARFDADDGTPTFAKDATYVARTGTAAGSVRFESYNYPGYYLRHYNYQLRVDPTDGTDQFRQDSSFNPVTAWA

SEQ ID NO: 336 - protein, 503 aa, Streptomyces avermitilis
MRTARFALDPAFTVGEVDPRLFGSFVEHLGRCVYTGVFEPGHPAADEAGLRTDVLDLVRELGVTAIRYPGGNFVSGYKWEDSVGPVDERPRRLDLAWRSTETNRFGLSEYVAFLKKVGPQAEPMVAVNLGTRGVAEALELQEYANHPSGTALSDLRAAHGDKDPFGIRLWCLGNEMDGPWQTGHKTAEEYGRLAAETARAMRQIDPSVELVACGSSGQSMSTFAEWEATVLAETYDLVDHISLHAYYEPLDGDVDSFLASAVDMESFIENVVATCDHVGAKLKSKKRINLSFDEWNVWYLSRHEESALADPLDWPEAPRLLEDNYSVLDAVVFGSLLIALLRHADRVTVACLAQLVNVIAPIMTEPGGASWRQTTFFPFAQAARYGRGQVLDVRVDSPRYETKKYGEADLLHATAVRADDGTVTVFAVNRSRTEPLPLEVALNGLELTSVVEHSVLTDTDPDARNTLDDQERVAPRTVSGTALQDGTLTAALAPLSWNVIRLA

SEQ ID NO: 337 - protein, 316 aa, Streptomyces avermitilis
MPERQSEPTPDESAPRPWSPFASSPASEPSHPGHLPLPTEEPPTPWQPGGTPDTSRVPGTRRLWLAGALALATVVACVTALTTTDHAADTSAAKEADTKLDSADPGLLTFASPSAGPSTYPGAKSGRSSERAAQTTPDGSASADPARHGSASKPAAERSKPASSTGTSSGSKPSAVWKSVRSVNYPDRYWHLGGDTGRLDPVSSGSSATTRQDATFKLVKGLADASCYSFATADGTYLRHSRFRLRADRNDGTALFKKDATFCPRTSSYSGAVMLESVNYPGRYLRHKDFLLRLDPYENTGQYRADSAFQLVKGWD

SEQ ID NO: 338 - protein, 710 aa, Streptomyces avermitilis
MSPTRTRWRLGLTAAALLVASVGVPAPAHAEDITDYAIAVDPKGSGAKIDDTMYGVFFEDINRAADGGLYAELVQNRSFEYATADNTSYTPLTSWNTSGTADVVSDDGRLNARNRSYLALGGDSSVTNSGYNTGIAVESGKVYDFSVWARADQADPLSVTLHDTDGDLARARRVTVRGGWAKYTARFTAGRTSTTGRLTVAAAGAVALDMVSLIPHDTYMGHGLRKDLAEKIAALHPGFVRFPGGCLVNTGSMRGYDEASGYERKRSYQWKDTIGPVEQRATNANFWGYNQSYGLGYYEYFQFAEDTGAMPLPVVPALVTGCGQNKAVDDDALLERHIQDTLDLIEFANGPVTSEWGRKRARMGHPEPFHLTHLEVGNEENLPDEFFARFTRFRAAIEAKYPDVTVISNAGPDDSGPTFDTAWKLNRDADVDMVDEHYYNSPQWFLQNNDRYDAYDRNGPKVFLGEYASGGNTFKNALAEAAYMTGLERNADVVKLASYAPLLANEDYVQWRPDMIWFDNHASWGSADYEVQKLFMTNTGDRVVPSTASGTPALSGPISGAVGLSTWATTAAYDDVRVTGEDGTTLLGDDFSGDASRWTHTGGGSWSVEDGQYVQSDVAAENTMVSAGDPAWHDYDLRVKATKKSGKEGFLVAFGVKDTGTYTLVAAPDAVNSRTATPVAPVTSVLEGVADRFTYTFPANSVTFLRIRQR

SEQ ID NO: 339 - protein, 536 aa, Streptomyces avermitilis
MTVPPSFLRPLSAAFAMLLLLVLAPALLVLRAAPPAQALDNGLARTPPMGWNDWNAFGCNVTEQLVKQTADYLVSSGLKGAGYQYVNIDDCWMTSARNSVGQLVPDPVKFPDGISGTAAYVHSKGLKLGIYESAGTATCQGYPGSLGHEQTDADSFASWGVDYLKYDNCNHQNVPDQQRYTAMRDALVNTGRPIVYSLCNWGLASVWTWGAGVGNSWRTTDDINVNFSTVVSIYKANVKLAPYAKPGAWNDPDMLEVGNGMSFTEDRSHFSLWSEMAAPLIAGTDLRKASAATLFLYGNKDVIAVDQDSLGKQGTEVSSSGGLHVLTKPLANGDVSVVLFNENSSAATITTSATAAGLPAASSYRLDNLWSHVVSSTGGSISASVPGHGSVMYRVSVGSGTSAGSTHPLVGASSNRCLDAYDNQTAPGTKIEIWDCGGANQAVTITAAGELRLYGGTQCLDAYDNGTTSGTKVQLYTCNGGANQKWSLNPNGTVTGTQSGLCLDVTGGDQASGNVNGTALELWTCNGGANQQWRLG

SEQ ID NO: 340 - protein, 608 aa, Streptomyces avermitilis
MGSSSYAVIPGAAPRSGRRSIRAVLVLALTAGVATVVPAAQADTSTPAAAPVAAKPYMGWSSWSMQSSKYPGLNPDGDYSYLTEANVLKQTDALASKLKKYGYDHVNIDAGWWMDKNWKTQFDQYGRQTPDPVRFPHGMKSVADHIHSKGLKAGIYLPVGLEKGAYGDGKTPISKAPGCTTADIVYSDLRTTNGWDNAYKIDFDKSCAQKYIDSQAQMFADWGYDFLKLDGVGPGSFKSGDNYNNVADVAAWQKAIAATGRPIHLELSWSLDIGHAADWKKYSNGWRIDTDIECYCNTLVTWENSVNDRWDDAPAWSSKAGPGGWNDLDAIDVGNGEMDGLTKAERQSYMTLWAINKSPLFTGDDLTKLDSYGVSLLTNKEVIAVDQNTSPVARPVTPVGDQQVWGTKNADGSYTVALFNLGDSPASVTAHWASFGFTGNASVRDLWNKTNLGTHKNKITEALPAHGSRLFTIKPGGGTLATTGYEAEAAANTLSGNASVGGCDACSGGKKVGNLYTGGKLRINDITVKKDGIYTVKVAYVSGDPRSVTVLSNSGNGTSLKFPSTGDWSTAETVSVQLALKAGSNTITFDSGSGYAPDIDRIVVPQSV

SEQ ID NO: 341 - protein, 682 aa, Streptomyces avermitilis
MRHPYARTTRTTRTTRTTRRRVVGALTAGLLCTAGLAAPALAAPAAGPVSPRPADSLALTPPMGFNNWNSTGCRPEFNEDMVKGTADIFVEKGLKDAGYQYVNLDDCWALPARDSNGKLVPDPARFPGGIKAVADYVHSKGLKLGIYTSAGTKTCNEAGFPGALGHEYSDAQQFADWGVDYLKYDNCNNQGVDAKLRYTTMRDALKATGRPIVYSLCEWGENKPWEWASDVGQLWRTTGDISDSWGSMLSILKQNLPLAPYAGPGHWNDPDMLEVGNSGMTDTEYRTHFSMWSIMAAPLLIGSDLRKASAATFDILDNKEVIAVDQDPLGKQGTVLSSEGGRWAVTKEMKDGSRAVALFNETDSAQRITTTAQAVGLPKAHAYTLRDLWQHRSYNTAGTISATVPAHGTVLVRVSADAAWAKNPPAVELGVDGSPLLEAGRTVALTSALTDLGRTPAKRVSVTLSGPRGWRVRATSPTTAGTVPTGRSLRTKWKVTAPDGTAAGSYDLTLKATYRSPTGVRAETLVPLAASVVPAPPSGVSYLGDLPWMSTTNGWGPVERNTSNGESAAGDGRPITVDGVVHAKGIGVHAESTIAYYTGRSCETVTADVGVDDEQDTNGSVTFEIWADGTRVASTGVLTTAMPARPLSADVTGAQVVRLVVTDGGNGITSDHADWADAKLSC

SEQ ID NO: 342 - protein, 863 aa, Saccharophagus degradans 2-40
MKQSHHNTKGKLGLGRALLCGLMLSVMLGSSAHAQFVHTDGTRILDENGEELNFNGINLGNWLLWEGYLMMGDFNYRTHTQFLNSLTDAFGSAAKAAEFEHQWRLNYVDEQAIADLSALGFNSVRVPFHYNMFWENGQLSNHGFQYFDRVIEWCRTYNMYVLLDMHAAPGYQNPGDHADNVDSNASQPRDTVKFWDGNNVQIAATVWRHIANRYKDEPVVWGYDLINEPVPQPTREFELLSSMVTMRNAIREVDNNHTIVVEGSWWSSDLTKIDWTDPEVQAASGVYSQWDDNLVYQLHHYGPLSDTVGRDAITDNLNIPLIIGEYGETDNGNLAAMTDWAKQNLSGYFPWSFKKMSHDKTLWTIPPNAAYNQVKAYINNGGTPPTHLYADMIAFAQNNVRNGHSSHQWHQGFYDAINPGNTPPPPPPPPPPAPTCDDSNAQTFTLPSRVQAEDHCASSGIQQESTGDIDGNQNIGWIDAGDWAEYNVTLNTAGEYTFAARVAANANAGTINVAVNGSQVGSLTAPVTGDWQVYQTTQITVNLPAGEHVLRLNFASAGMNVNWFEVSEGQAPPPPPPVNPCDGFMQNLPSKVEAEDYCDMNGLQTEATSDSGGGENIGWIDAGDWADYGINVDTNTHFILKLRVASQNGGGKVNINVDGANVGGFDVSSTGGWQNWQTLSMPLTLSAGNHVLRLDFLAGGLNVNWVEFTPATTTPPTEPPATGELEEGTYYITNEASGKALDVSGVSTSNGANVHQWAYGGGLNQQWNAQHVSGNTFELVSLNSGSCLDADSGSDNAHQWACEGNTNQQWVIEEQSDGSYLIRTKAGNEVLEVQNGSANNGANVRTAGAANSDRQKWRFNIVQ

SEQ ID NO: 343 - protein, 853 aa, Saccharophagus degradans 2-40
MKSTKIFTRKKLALSTMLIASAIGLQACGGSSNGPQNIVPVPPAFEEPAAGAESYSMLKAEGTLWMNQAGEKVSLRGINIGNWLSMEFWMFDNGNDPLGAGIPDQCTLEATLEERFGEAEKDRLISVHRDSWFVEQDWDVIDEAGFNLVRVPFPHNLIEDDANPMTLKENAWDYLDWAIAEAKEREIYVVLDLHGAAGGQGYEQHTGCEGQNMLWESEEYQERTKWLWGKIAERYNGEATVAGYGLLNEPWGTDSATLRDFSIELYDAVREYDEDHIVILAGHNADGITAYGDPLDYGMENVAFEPHFYPGLFGWGDIGYEVHRDWLTCGQAGDTGVCDWAKQARDVYTPMLVGEMQPWNGLGELGGEITRATFDTYNDLNWAATAWSYKVTTPSGGLGNGTWGYVTNNGNQLLVKAQTWGCDGWEDTFATACDVSARATVPYEGEGTKTMYLAIKTGGFTQVDVIYDEIQLVDSQGNNIVTNGSFGAGSEADWTEISLWGDERNYDYDYAAGEFAGSDTGAAFRAVSPAGSHAVIYQAVEVTGGESYTISGKFIDANSTDTWAEIYLVPEMPQEWVDVTGRALPSINVNEATVEDIENYFSFFAYGNMDYVVNDWVKDALTSAAPASVFTNIPGAASDVTFTLGAADDNGIAATTLTWASATGDVTGYKIYRSTAPRSGFTVVGESDTTTYTDNTSTADVTYYYYVAAFNDSDEGYGSDIIATGETFYTVPSKIEAENYTAAHPGVNTEGASDIGGGSNIGSFETGRWVDYEINVPTAGVYSIDFRLASQVGDVQFQVKIGSDVLTTVTVPNTGGWQDYVTNTYEITLPEGRSTLRLESIDNQWNLNWFEIK

SEQ ID NO: 344 - protein, 869 aa, Saccharophagus degradans 2-40
MREKLLRALLTSAKFFGASLLLLSLFNLTACGGGSSGTKPVVEEPQPEPQPEPEPEPEPEPEPEPEPEPQPEPEPEPDFSALHTDGTKWVNANGDQVLLKGVNLGNWLLQEFWMMEQGSEDVNDQCSLEAVFDDRFGFAERERLMDLFRDNWINDRDWDIIASFGMNVIRLPFIWNLIEDENNPMTLRDDAWQYIDYAIEQAEARDMYVILDLHGAVGAQGWEHHSGCAELNEYWGSEAYQERTRWLWQQVATRYADRDAVAAYGVLNEPWGTTPENLAVEAIELFDAIREVDADKIIILPGHHSGIHAYPNPATVNQTNVAYEMHFYPGIFGWGEIGYDVNRDWLTCGPTGTSGVCEWDARLDALDSPFLIGEFQPWTGLGPELGAQITRATYDTYASFDWASTAWSYKIITSGGGQGGGTWGMVTNERGLGLLAKADTWACAGWDSSFANACGVSRTGFTPDREGEQTYYLVIKFGACCEGNLDATLDSISIIDDVTGEEIIVNGGFGAGTGWTEWYESAMPIIDYNYTGAGVPTGSDGAVLRMSGAAAINGGVYQAITLDSSKSYSFSGVFKDNGSASAWAEIFLVQSQPVDGSDVLAEGPFAAVDFLTAPIEEIENLFEAFGTTPYDIHEEMRAAMTAETAPTLFDLPGAPTGVMLAEDAGAATISWTASGDANVTGYNVYRSTISGNSYTLLAENVTATTFVDSTIDGEQTFYYTVTAVTDTAESYRSQEVATTFVAVHLPGKVEAEAHSDMMGLQTENTTDTGGGINIGFIDAGDWFEYEVTIDTAATYNIHYRLASEPGSTGFTVSINDEVLNTVAVPATGGWQTWQTESTTITLPAGEHTLRFDALGGQWNMNWWSVEAVD

SEQ ID NO: 345 - protein, 1167 aa, Saccharophagus degradans 2-40
MTIKRWPFDRKGPPKKPNAKKLLASLAAALSLTAMQSTAAVEPLQTSGNQILVGNQAKALGGHSLFWHNVPAAGSLYNADTVSRLKNDWNSKVIRAAIGVEVPFNSENTYIGNKGSSLAAIDRVVNAAVANDMYVIIDFHTHHADQVENVAHDFFNEVSSRYGHLNNVIYEVFNEPEWCGEHGRWASTIKPYAERVIQTIRNNDPDNLVIVGTTCFSQDVDVAAADPINDVNVAYTLHFYAATPAHQQPLRDKAQTALDRGAPLFVTEWGTTTFTGDGFVDEAQTRTWINWLNERGISHVNWSASTQPESSAIWNGDMTYKHSGLLVGELVQQTNGTTTPPTGEISGPCDLHFVPAKAEAESFCTAKGIQFETTTDTGGGQNMGWLDAGDWVTFDVDVPASGQYLIDYRVASELGDGRFRTEAANGTALGTISVPNTGGWQNWQTHTHTVQLSQGTQTVKLVAETGGWNLNWFEVRAGEVCEGADCPCEGAECPCPDCNGTPVKFEAETFVAMQGVQLENTSDVGGGQNVGYIDSGDWITYNGALPASADNRYVVSYRVARQPSGNAKFKIEQPGGAAVYGEISVPSTGGWQTWTTISHTITIPANANGFALAAIDGGWNINWIEIKPATTQPPEPINPLKLQAEDYINFNDTTPGNEGGAHRSDDVDIQATTDTGGGFNVGWVDAGEWLEYEFFLESPDFYAADVRVASDQTGGALQLQIDGQNVGQAITVGNTGGWQAWTTKNTLIGDLSAGTHTLRVYAQSGPLNLNWVELKRTTPAPATSCFNIAEDRLNVHLDAHCTAGSNLQYNWDFGDGNSATGVATSHSYYTSGTYTITLTVSDTRTTDTSSQQVTVDFSAPAGPVDFYGELMVNGNRIHGEKTGEPAQVRGMSFFWSNTGWGQEKWWNASTVDRMVDEFKVELVRGAMGTDEGGGYLHDASNKARLQAVVEQAIARNVYVIIDWHTHHAEDNIAEAITFFSEMAQLYGHHDNVIFEIYNEPLNTTSWGTIKHYAEQVIPAIRAHSDNLIVVGTRTWSQNVDEAAFDKINDSNTAYALHFYVGSHGNHVRNLAQTALNNGAAIFASEWGIWPNNNYDGMNADDWMNFLDQNKISWANWAISDKVDPNTGQLEPPSMFNPDGSLSSNGQYVVNKLNEYAAQAPWREAIAN

SEQ ID NO: 346 - protein, 673 aa, Saccharophagus degradans 2-40
MLIGTVTASALVGRGRGTPKKIINKGSIMWQINKSALAAVVLVCSSSSFAQSACDTQRIEAENYVAMSGIQTESTADTGGGLNVGWIDAGDWLSYQVNLPAAGQYEVRYRVASRNGGGVLRLEGNAGQTLYGTMNVPNTGGWQNWQTLSHSVTLAAGEQSIGIGVPSGGFNINWLEFVPLDCSGPIDPPINPPSNCASIVFEAENYDQMSGIRTQTTSDTGGGLNVGWIDAGDWLSYATVNIPSTQVYNFEYRVASPNGGSFNLQGSAGAENFDTATLPNTGGWQNWTTVTGSALLPAGNVNFGISAITGGWNINWFKATPESCDDINPPSTGITAKQAAAAMGKGFNLGQMFESTQHPRTFNAAKSKIDAYYNMGYRNVRIPITWTEAVGGNRLVADANVGAVNRNHSRLAVITQVVDYALSLPGMYVVINAHHEGGLKTNNRWWVLETLWADIADIFKDRDHRLLFEILNEPHLSDANKSPMPPANLRFMTGKAYNKIRAIDAQRIVIIGGNQWFGAGEMANVWPNLNDVGGGSDAYVMATFHHYDPWSFSGDNQGDYADAWTLSNVGNPMDIMQSWANGVGQGMPVYIGEWGVGWGSRYSAMQCNNIRYWYQLFDASYASAKGQPTAVWDDGGWFKIFDHGTNSFNNNLAQCIGGNCAWDGADRFNSGCN

SEQ ID NO: 347 - protein, 365 aa, Saccharophagus degradans 2-40
MRTTKFLALALCLLASASALSANNSAPSNDWWDIPYPSQFDVKSLKTQSFISVKGNKFIDDKGKTFTFRGVNIADTGKLLSQNQWQKSLFEELANNWGVNTIRLPIHPVSWRKLGPDVYLGHIDEAVRWANDLGIYLILDWHSIGYLPTEQYQHPMYDTTIKETRDFWRRITFRYKNVPTVAVYELFNEPTTMGNTLGERNWAEWKTLNESLIDMIYASDKTVIPLVAGFNWAYDLSPIKKAPIEREGIAYAAHPYPQKAKPEVKNDKNFFKLWDEKWGFAADTYPVIATELGWVQPDGYGAHIPVKDDGSYGPRIVKYMQKKGVSYTVWVFDPDWSPTMINDWDFTPSEQGAFFKQVMLEAKKR

SEQ ID NO: 348 - protein, 610 aa, Saccharophagus degradans 2-40
MMYTNLFNLKKHLFQTSLKLLACATLIGGTLNAAADVPAMSVQGNKVLVGGEVKSLGGMSYFWSNNGWGGEKYYNASTVSYFKQDWKASIVRAAMGVEDAGGYFDDPQGSKQKVRTIVDAAIANDMYVIIDWHSHYANTHDWAAAVQFFQEMARDYGQYNNVIYEVYNEPLDIPWGHIKSYAETVIDAIRAIDPDNVIVVGTPRWSQGVKEASWDPINRNNIAYTLHFYSGSHGQWLRNDAAEAMSNGIALFVTEWGSVNANGDGAVNEGETAAWMNFMRDNGIHHANWSVNDKAEGASALNPGASATGGWGDGDLTWSGHVVRGYLRDWNQIGSGNGNGNGTGCTEVSLPGTIEAEAYCAMDGIQTENTNDTNGGSNVGYIDAGDWMSYSVNVANAGTYTVSYRVASLGGGGVLSIENAGGSPVYGTLNVPQTGGWQEWTTVSHDISLQAGQQNIGIAAIEGGFNINWIALTPAGTNPNPVQSITLQAEDYSFMSGVQVENTSDNGGGMNVGWLDAGDWLAYHGVNIPTSGQYTITYRVASQSGGGSLQLEQAGGGVVYGNLNVPSTGGWQNWVDVSHTVTLNAGVQDFGLGITSGGFNINWIKVEAIH

SEQ ID NO: 349 - protein, 578 aa, Saccharophagus degradans 2-40
MNKVKVLALCASVAVMIGCSDADTKLANSAKAEVGFTKVNQLGYLPAAKKLAVVPAVAAAKFDIIDVTSGKVAFTGSLSDVKSWSAMGDESFKLADFSALQAEGSYRLVVQGVSDSYTFDISPSVYSQAHDGALKAYYYNRASTELTEQYAGVYARPAGHPDTDVRIFDNAASAARPADTSFAAPKGWYDAGDYGKYIVNSGISTYTLMAAYEHFPSFYKQRDIDIPESGDAVPDILDEVMWNLEWMQVMQDPNDGGVYHKLTTLNFSGAVMPHEATAQRYFIKKSTAATLDFAAVMATASRVYAPFEGAFPGKSAAYRQAAIAAWEWAQANPSETYSQTPLSKVQTGAYGDKKLNDEFAWAAAELFILTGEQKYWQAFNKQKVQAGESSWANVAGLGFISLANNARSLLNEAQYKTVTDSIVRAADSLLVTYKENAYQVPIGNKDFFWGGNSGTLNRAWVLLEANKIKPQQEYIDAALAAVDYIYGRNPTNYSFVTGFGDNPAVGIHHRPSYADGIKAPVPGWLAGGAHNGKQDGCEYPSDAPAKSYLDDWCSYSTNEIAINWNAPLVYILAAVNNL

SEQ ID NO: 350 - protein, 1072 aa, Saccharophagus degradans 2-40
MKNTLSFKTSLLAGLVASSLLVAACQGVKQQTEATQTKHNITLWPQASSPVIKSPDYEAEVEAKVEALLGQMTLEQKVGQILQPEIQSIKPHEVKEYHIGSVLNGGGSMPNRIENAPPIEWVKLADAFYDASMDDSDGGIAIPIIWGTDAVHGHGNVTGATIFPHNIGLGAARNPALIEKIGEITAKEVRATGIEWIFGPTLAVAQNDLWGRTYESYSEDPAIVADYASAMVVGMQGKVDDSDFLSTNRVVATAKHFLADGGTLGGNDQGDARISEEELVQIHNAGYVPAIESGVQTVMASFSLWNGVKMHGNNYLLTQALKERMGFDGFIVGDWNGHGQVPGCTNESCPQSLNAGLDMYMVPYDWKKLYRNLISQVQSGEIAPSRLDDAVRRILRVKIRANLWAAKPSERINLATIDEVVGHANHREVARQAVRESLVLLKNKNSVLPIAANKTVLVAGDGADNIGKQSGGWSVSWQGTGNTNASFPGGTSIYKGIADAVTQGGGKATLSVDGSYKTKPDVAIVVIGEDPYAEGQGDRNSLEFEPVNKKSLELLKKLKADGIPVVTVFISGRPMWANPEINASDAFVAAWLPGSEGQGVADVLIGNANGKPRFDFKGTLSFSWPKLPTQGLLNPTHPNYDPLFKLGYGLTYASSETGPEQLAEDVEGVDKGSTGDINFYVGRTLEPWEVFVRTPESSQRLSGPFADLGNASVRTSDMQVQEDALTFTWGGSWMSILGIEGGRGYDLSSQYKEGGVISFNFNSIDMAKGDLKVQMACGEGCTREVDITTIARDLEGKGWQSLTVPLACFAHEGDDFTHITAPFNLFAGGKGQVAVANIRILRAGTQTVPCVLPKDVSVTPEPLNASWAIDWWMPRHKEKLARIQQGNVDLLMIGDSITHGWEDAGKDVWAQYYAHRNAVDLGFSGDRTENVLWRLQHGEADGIKPKVAVVMIGTNNAGHRHEPSHYTAKGVAAVVAELQKRLPETKILLLGIFPRGETSEDPLRVLNAKTNTLLAKMADGEKVVYLNINKTFLDENGVLPKDIMPDLLHPNEKGYALWAKAMEPTLKKMLGE

SEQ ID NO: 351 - protein, 862 aa, Saccharophagus degradans 2-40
MLKKINKKGLALSLAIAAMLSGCNEGDSNKTKPSAETLSATQASNTVANPSIWPKVTSKVAKDAKMEADISAILSGMTLEQKVAQMIQPEIRAFSKEDMKKYGFGSYLNGGGAFPNDNKHSTMADWVALADDMYEASIDDSIDGSTIPTMWGTDAVHGHNNVVKATIFPHNIGLGAMHNPKLMQQIGAATAKVVQVTGIDWVFAPTVAVVRDDRWGRTYEGYSEDPAIVKEYARAMVIGMQGEANSEAFMGDGTVIATAKHFLGDGGTDKGDDQGNNLSTEQELIDIHAQGYISAIEEGVQTIMASFNSWNGEKMHGNKSLLTDVLKKQMGFDGLVVGDWDGHGQVKGCSNASCAQAINAGVDIIMVPNEWKPMFENTVAQVKSGEISEARINDAVTRILRVKMRAGIFDGVKPSDRAFAAEEKYLGSAENRAIARQAVRESLVLLKNQNKLLPLDRKMNVLMAGSGADNIGKQSGGWTLSWQGTGNVNSDFPGATSIYDGVNQVVSSAGGKVELSENGNYQAKPDVAIVVFGENPYAEGVGDIEGIEYQLNNKRDINLLQKLKADGIPVVSVFLTGRPLWVNKELNASDAFVAAWLPGSEGVGVSDVLFKKADGSINYDFKGKLTYSWPKYDDQVVINKGDKDYAPLYPYGYGLTYSDVDTQGDDLPEETKVKIGRADDEPMAIFDSLPQSDLGFFLGDKANWVVPIATSVVTTHNSDNLTMRTYNWKVQEDARQLIWKGDSKANAFFAWPDPHNMQGMLEHKAAYSFSIKVDKAPAGDLTLGIHCMEECGKKLVLNEALSKIPAGEWGELTIDLACIADAEALAEVRSPFMLSTDAPASIVFGDVKLVPGGADSAAIKCD

SEQ ID NO: 352 - protein, 461 aa, Saccharophagus degradans 2-40
MKTFNPDFVWGAASSAYQVEGATTTDGRGPSIWDAFSSIPGKTYHNQNADIACDHYNRWQEDVAIMKEMGLKAYRFSISWSRIFPTGRGEVNEKGVAFYNNLIDELIKNDITPWVTLFHWDFPLALQMEMDGLLNPAIADEFANYAKLCFARFGDRVTHWITLNEPWCSAMLGHGMGSKAPGRVSKDEPYIAAHNLLRAHGKMVDIYRREFQPTQKGMIGIANNCDWREPKTDSELDKKAAERALEFFVSWFADPIYLGDYPASMRERLGERLPTFSDEDIALIKNSSDFFGLNHYTTMLAEQTHEGDVVEDTIRGNGGISEDQMVTLSKDPSWEQTDMEWSIVPWGCKKLLIWLSERYNYPDIYITENGCALPDEDDVNIAINDTRRVDFYRGYIDACHQAIEAGVKLKGYFAWTLMDNYEWEEGYTKRFGLNHVDFTTGKRTPKQSAIWYSTLIKDGGF

SEQ ID NO: 353 - protein, 444 aa, Saccharophagus degradans 2-40
MNRLTLPPSSRLRSKEFTFGVATSSYQIEGGIDSRLPCNWDTFCEQPNTIIDNTNGAIACDHINRWQDDIELIANLGVDAYRFSIAWGRVINLDGSLNNEGVTFYKNILTKLREKNLKAYITLYHWDLPQHLEDAGGWLNRDTAYKFRDYVNLITQALDDDVFCYTTLNEPFCSAYLGYEIGVHAPGIKDLASGRKAAHHLLLAHGLAMQVLRKNCPNSLSGIVLNMSPCYAGSNAQADIDAAKRADDLLFQWYAQPLLTGCYPDAINSLPDNAKPPICEGDMALISQPLDYLGLNYYTRAVFFADGNGGFTEQVPEGVELTDMGWEVYPQGLTDLLIDLNQRYTLPPLLITENGAAMVDELVNGEVNDIARINYFQTHLQAVHNAIEQGVDVRGYFAWSLMDNFEWALGYSKRFGITYVDYQTQKRTLKASGHAFAEFVSSRS

SEQ ID NO: 354 - protein, 811 aa, Saccharophagus degradans 2-40
MKFGHFDDKAREYVITDPKTPYPWINYLGNEDFFSLVSNTGGGYSFYKDAKFRRLTRYRYNNVPVDNGGKYFYINDSGDVWSPGWKPVKAELDAYSCAHGLSYTRITGERNGIQAEVLSFIPLGTWAEIQKVSLKNTSGATKKFKLFSFAEWCLWNAEDDMTNFQRNFSTGEVEVEDSVIYHKTEFKERRNHYAFYSVNAPIQGFDTDRDKWKGLYNDFDKPDAVFEGEPRNSEAHGWSPIASHYLEVELAPGESKDLIFVLGYIEVAPENKWESKGVINKSPAKELIARFDSVEKVDAELTKLADYWANLLSTYSVESGDEKLDRMVNIWNQYQCMVTFNMSRSASFFESGIGRGMGFRDSNQDLIGFVHQVPERARERIIDIASTQFEDGSAYHQYQPLTKRGNNAIGGNFNDDPLWLILSTTDYIKETGDFSILEEQVPYDNDASKATSHFEHLKRSFYHTVNNLGPHGLPLIGRADWNDCLNLNCFSEDPNESFQTTGNKTGRTAESLMIAGLFVLYGNEFVKLCREIGQDGEAAEAQAHIDQMVEAVKKHGWDGEWFLRAYDYYGKKVGSKENEEGKIFIESQGFCGMAGIGLEDGLVEKSMDSVKEWLDCDYGIVLQQPAFTKYYIEYGEISTYPAGYKENAGIFCHNNPWIMITETLLGRGDKAFEYYRKIAPAYLEEISDLHKVEPYAYCQMIAGKDAYLPGEGKNSWLTGTASWNFAAITQYILGVKPDYSGLAINPCIPSSWDGFKVTRKYRGATYNIIVTNPTHVSKGVKSLTLNGNAIDGYIVPPQQAGTVCNVEVTLG

SEQ ID NO: 355 - protein, 788 aa, Saccharophagus degradans 2-40
MLKAINNGERYQLTSPTAMPQSASFLWNKKMMIQVNCRGYAVAQFMQPEPAKYAYAPNLEAKTFMQPEQPYYAHHPGRFFYIKDEETGEIFSAPYEPVRSQLNNFSFNAGKSDISWHIAALGIEVELCLSLPVDDVVELWELKIKNGGAQPRKLSIYPYFPVGYMSWMNQSGDYSQTAGGIIASCVTPYQKVADYFKNKDFKDKTFFLHETAPAAWEVNQKNFEGEGGLHNPNAIQQETLGCGNALYETPTAVLQYRRELAAQEQQTFRFIFGPAFDESEAIALRNKYLSAEGFAKAKSEYQTYITSGKGCLQINTPDPELNNFVNHWLPRQVFYHGDVNRLTTDPQTRNYIQDNMGMSYIKPNITRQAFLHALSQQEESGAMPDGILLLEGAELKYINQIPHTDHCVWLPVCMQAYLDETNDYALLDEIVPYASGEKRETVEQHMHHAMRWLLQARDERGLSFIAQGDWCDPMNMVGYKGKGVSGWLSVATAYALNLWADVCEQRQQNSCANEFRQGAKDINAAVNKHIWDGEWFGRGITDDGVLFGTSKDKEGRIFLNPQSWAILGGAADEQKIPCLLDAVEQQLETPYGVMMLAPAFTAMRDDVGRVTQKFPGSAENGSVYNHAAVFYIFSLLSIGESERAYKLLRQMLPGPDEADLLQRGQLPVFIPNYYRGAYYQHPRTAGRSSQLFNTGTVSWVYRCLIEGVFGLKGSPQGLVVQPQLPVAWQTAEAVREFRGATFNVSYRKSSDIKEMEIQLNESVISGNTISDITAGATYQLTVLLPATH

SEQ ID NO: 356 - protein, 457 aa, Saccharophagus degradans 2-40
MVNYLKRAALCMLALVAVACAKSQPETKVEELPATKTAANAGVAATEFVQVNGGRFTLRGQDYAYIGTNMWFAAYIGSTNPEYGDRERLIKELDLLKSLGVTNLRILGASEKSPLRDSMKPAISERGEINQHDILEGLDFALAEMAKRDMKAVIFLNNFWEWSGGMATYLSWVNGGEIVDMADPTKPWPAFALFSAGFYSNEEAKQLFNNYLTKVVSRRNTITGELYANDPTIMSWQLANEPRPGNGDVSKSNLPAYYDWISKTTQLIKSIAPKQLVSIGSEGTMGCLELDECVITAHKETGIDYVTFHMWLKNWGWFDVQNAEQTYDSAVATADKYIDHHIKLANELNMPVVLEEFGMERDGGEFSPESAVTYRDKFYAYVFDRQIKSIRSGGPFVGSNFWAWGGYGKAMHDDAVWRKGDKTFVGDPPQEPQGLNAVFASDTSTLEVLKQAADAIR

SEQ ID NO: 357 - protein, 821 aa, Saccharophagus degradans 2-40
MVVNTDITQWSLTKTNANGAQTPADIIPLQQWLAVPVPGTVAQAVGDAGPQEDLEQFDWWYTAQFPLPKTGKRTYLQCDGLATLSEVWVNDQQVLYSQSMFENHKLDITDYLQADNTLAIVFKALAPHLAERRARPQWKTNLVDNQNLRWFRTSLLGRMPGWTPPVKAIGPWRDISIVSVAKFDLVECTVFSEVDEALNGKVHINLELDFIDAKLAADPQIQFLLDGKIYPITAKPIKGGGAFIDTEIAIEQPQLWWPHTHGEPYLHAYKITAIIDGEVTTLTEGKLGFKRVTAANQTNQLALEVNNNKIFCRGACWATPNITSLNASKQEYRHLLKLLVDAGANMVRIGGTMVYEHDDFYALCDELGILVWQDFMFANMDYPFADEDFSKLVAKEVRQQITRLKQTASIAVFCGNSEMQQQAAMMGMEQTQWANALFDTFITQKLEEQQLTLPYFTSSPCEGGLPFHTDAGLTHYYGVGAYKLMPDHFTVREVGFTSECLGFSHIPVTASLKQAFESPYPATHTPSWKAGIPRDNSAGWDFEDIRNFYLEKIFGVVADTLRYSDPETYFKLATIATAEMVSSVYSIWRASISNCNGALAWFYQDIVAGAGWGIVDSFARPKAAYYFLKRVWQPQQVLLINNSLNGYTLEVQNETAHTLQAQLNIVLVGLSDNIVAEHTQEITLAANSVGTHKLDTVFGRFMDATHAYKFGRQTIYAVVAELRNESGELISQAVSFPGCRRINTGAGEITGSITSDSDNESVVTLTPSVFVEYACLESKTTQFSDNYTCMLPGKTYSFKACEQIKSVHVSTLNLQKEFRVT

SEQ ID NO: 358 - protein, 232 aa, Bacillus subtilis
MKKIMSAFVGMVLLTIFCFSPQASAAYDDLHEGYATYTGSGYSGGAFLLDPIPSDMEITAINPADLNYGGVKAALAGSYLEVEGPKGKTTVYVTDLYPEGARGALDLSPNAFRKIGNMKDGKINIKWRVVKAPITGNFTYRIKEGSSRWWAAIQVRNHKYPVMKMEYEKDGKWINMEKMDYNHFVSTNLGTGSLKVRMTDIRGKVVKDTIPKLPESGTSKAYTVPGHVQFPE

SEQ ID NO: 359 - protein, 499 aa, Bacillus subtilis
MKRSISIFITCLLITLLTMGGMIASPASAAGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPSKDKPTQENGISVQYRAGDGSMNSNQIRPQLQIKNNGNTTVDLKDVTARYWYKAKNKGQNFDCDYAQIGCGNVTHKFVTLHKPKQGADTYLELGFKNGTLAPGASTGNIQLRLHNDDWSNYAQSGDYSFFKSNTFKTTKKITLYDQGKLIWGTEPN

SEQ ID NO: 360 - protein, 422 aa, Bacillus subtilis
MIPRIKKTICVLLVCFTMLSVMLGPGATEVLAASDVTVNVSAEKQVIRGFGGMNHPAWAGDLTAAQRETAFGNGQNQLGFSILRIHVDENRNNWYKEVETAKSAVKHGAIVFASPWNPPSDMVETFNRNGDTSAKRLKYNKYAAYAQHLNDFVTFMKNNGVNLYAISVQNEPDYAHEWTWWTPQEILRFMRENAGSINARVIAPESFQYLKNLSDPILNDPQALANMDILGTHLYGTQVSQFPYPLFKQKGAGKDLWMTEVYYPNSDTNSADRWPEALDVSQHIHNAMVEGDFQAYVWWYIRRSYGPMKEDGTISKRGYNMAHFSKFVRPGYVRIDATKNPNANVYVSAYKGDNKVVIVAINKSNTGVNQNFVLQNGSASNVSRWITSSSSNLQPGTNLTVSGNHFWAHLPAQSVTTFVVNR

SEQ ID NO: 361 - protein, 513 aa, Bacillus subtilis
MRKKCSVCLWILVLLLSCLSGKSAYAATSTTIAKHIGNSNPLIDHHLGADPVALTYNGRVYIYMSSDDYEYNSNGTIKDNSFANLNRVFVISSADMVNWTDHGAIPVAGANGANGGRGIAKWAGASWAPSIAVKKINGKDKFFLYFANSGGGIGVLTADSPIGPWTDPIGKPLVTPSTPGMSGVVWLFDPAVFVDDDGTGYLYAGGGVPGVSNPTQGQWANPKTARVIKLGPDMTSVVGSASTIDAPFMFEDSGLHKYNGTYYYSYCINFGGTHPADKPPGEIGYMTSSSPMGPFTYRGHFLKNPGAFFGGGGNNHHAVFNFKNEWYVVYHAQTVSSALFGAGKGYRSPHINKLVHNADGSIQEVAANYAGVTQISNLNPYNRVEAETFAWNGRILTEKSTAPGGPVNNQHVTSIQNGDWIAVGNADFGAGGARSFKANVASTLGGKIEVRLDSADGKLVGTLNVPSTGGAQTWREIETAVSGATGVHKVFFVFTGTGTGNLFNFDYWQFTQR

SEQ ID NO: 362 - protein, 213 aa, Bacillus subtilis
MFKFKKNFLVGLSAALMSISLFSATASAASTDYWQNWTDGGGIVNAVNGSGGNYSVNWSNTGNFVVGKGWTTGSPFRTINYNAGVWAPNGNGYLTLYGWTRSPLIEYYVVDSWGTYRPTGTYKGTVKSDGGTYDIYTTTRYNAPSIDGDRTTFTQYWSVRQSKRPTGSNATITFSNHVNAWKSHGMNLGSNWAYQVMATEGYQSSGSSNVTVW

SEQ ID NO: 363 - protein, 533 aa, Bacillus subtilis
MKITNPVLKGFNPDPSICRAGEDYYIAVSTFEWFPGVQIHHSKDLVNWHLVAHPLQRVSQLDMKGNPNSGGVWAPCLSYSDGKFWLIYTDVKVVDGAWKDCHNYLVTCETINGDWSEPIKLNSSGFDASLFHDTDGKKYLLNMLWDHRIDRHSFGGIVIQEYSDKEQKLIGKPKVIFEGTDRKLTEAPHLYHIGNYYYLLTAEGGTRYEHAATIARSANIEGPYEVHPDNPILTSWHDPGNPLQKCGHASIVQTHTDEWYLAHLTGRPIHPDDDSIFQQRGYCPLGRETAIQKLYWKDEWPYVVGGKEGSLEVDAPSIPETIFEATYPEVDEFEDSTLNINFQTLRIPFTNELGSLTQAPNHLRLFGHESLTSTFTQAFVARRWQSLHFEAETAVEFYPENFQQAAGLVNYYNTENWTALQVTHDEELGRILELTICDNFSFSQPLNNKIVIPREVKYVYLRVNIEKDKYYYFYSFNKEDWHKIDIALESKKLSDDYIRGGGFFTGAFVGMQCQDTSGNHIPADFRYFRYKEK

SEQ ID NO: 364 - protein, 985 aa, Clostridium phytofermentans
MKKIISLLLVITLLISMAPSKADAAETNYNYGEALQKSIMFYEFQRSGKLPSTIRNNWRGDSGLTDGADVGLDLTGGWYDAGDHVKFNLPLAYTVTMLAWAVYEEEATLSKAGQLSYLLDEIKWSSDYLIKCHPQANVFYYQVGNGNTDHSWWGPAEVMQMARPSYKVDLNNPGSTVVGEAAAALAATALIYKTKDPTYSATCLRHAKELFNFADTTKSDAGYTAASGFYTSYSGFYDELSWAATWIYLASGEATYLDKAESYVAKWGTEPQSSTLSYKWAQNWDDVHYGAALLLARITNKAIYKNNIEMHLDYWTTGYNGSRITYTPKGLAWLDSWGALRYATTTAFLASVYADWSGCSAGKVSTYNAFAKQQVDYALGSTGRSFVVGYGVNSPTRPHHRTAHSSWADSQTEPNYHRHTIYGALVGGPGNNDSYEDNINNYVNNEIACDYNAGFVGALAKVYKTYGGTPIANFKAIETVTNDELFIQAGINASGPSFIEVKALVFNETGWPARVTDKLSFKYFIDISEYVAKGYTKNDFTVSTNYNNGATTSALLPWDAANNIYYVNVDFSGTKIYPGGQSAYKKEVQFRIAGPQNVNIWDNSNDYSFTQIANVSSGNTVKTTYIPLYDNGKLVFGNEPKTGVPSASLDKTTANFDKNPAVSADIPVTINYNGNTLTAVKNGTTVLTKGTDYTVSGNVVTLSKNYFLAQSASTVTLTFVFSGGNDATLKVTLVDTSPSASINPNSAVFDKASGKQENIVITLTPNGNTLAGLKNGSKSLVTGTDYTVSGTTVTILSSYLSQFAVGSQSIVFEMNKGTNPVLAVTIKDSSVVTPTGNIKLQMFNGNSSATTNGIAPRIKLINTGTTAINLSDVKIRYYYTINGEKDQAFWCDYSTIGSSNVNGTFVKMSTPKTNADYYLEFSFKSAAGTLNAGQSIEVQGRFSKVDWTNYTQTDDYSFGDSNSSYADWNKTTVYISDVLVWGVEP

SEQ ID NO: 365 - protein, 919 aa, Clostridium phytofermentans
MQKRIYKRVAAAIMTAAMVVTLVPQGAKTSALAGETEQALAAAATRGTYEQRFMDLWSDIKNPKNGYFSPQGIPYHSIETMIVEAPDYGHVTTSEAMSYYMWLEAMYGKFTGDFSGYGTAWNVAEKYMIPTDADQPPTSMSKYTPSKPATYAPEYQDPSQYPAKLDSSAPVGSDPIWSQLVAAYGRNTIYGMHWLLDVDNWYGFGSRGDGTSKPSYINTFQRGEQESTWETIPQPCWDTMKYGGTNGFLDLFTGDSSYAQQFKYTDAPDADARAIQAAYWASEWAKDYGVNVDTYSSKATMMGDYLRYSMFDKYFRKIGNSTVAGTGYDASHYLLSWYYAWGGGITADWAWVIGSSHNHFGYQNPMAAWVLSQNSKFKPKTTNGQADWATSLTRQLEFYQWLQSSEGGIAGGASNSKNGRYETWPAGTATFYGMGYEANPVYKDPGSNTWFGFQAWSMQRVAEYYYKTNDVKAKQILDKWVAWVKSVVVLKADGTFTIPSTLDWSGQPDTWTGSYTGNSKLHVTVVDSGTDLGVTGSLANALLYYSKAANDVAAKNLAKELLDRVWKLYRDDKGVAAPEARADYKRFFEQTVYVPSTFNGKMPNGDVIKSGIKFLDIRSKYLQDPSYPKLLAAYQSNKSPEFIYHRFWAQCDVALANGVYALLYENGSGTTDYANINPTNGSFDKAVGKQADLSTTLSMQGYTFVNLSKGTTPLTLNTDYTVNGTTVVLKKEFLSTLPLGDTTITFNFSNSYTKPFVVTVVDTTVVVVVGDVKVQMFNGNTSATTNGIAPRFYLVNTGSNSINLSDVKLRYYYTIDGEKSQSFWCDWSSIGSSNVTGTFVKMATPKTGADYYLEIGFTSGAGSLKAGQGIEVQGRFSKTDWSNYTQTGDYSFNSSGNSYVDWNKATAYISGKLNWGIEP

SEQ ID NO: 366 - protein, 469 aa, Clostridium phytofermentans
MCVELMRKFPIIVSGILVCATLLSGCSQNMSNVDKSTVNLNSQNTDNQNQDANNKDSDNQGANNQESNNQESQNPELKNTPTPQIIVLPGDSTIEANEIVAPTITFEQKEIPSNPAITFVHNMKIGWNLGNTFDAVSDSNLMDELNYESSWCGVKTTEEMMKAIKDAGFQSIRIPVSWHNHVSGDDFIISEVWLNRVQEVVDYAINNDMYVILNTHHDVSKNFYYPSNENLESSKKYINAVWTQVSERFSSYGEKLLFEGMNEPRLAGSNYEWWLDLSKPECKEAIECINQLNQEFVDTVRKSGGENTSRYLLIPGYDASSQYALINDYKLPKDNINDRLIVSVHAYLPYDFALKSPKESGSISEWNSKIAGCTKEIDSFLNSLYMKFIKNGVPVIIGEFGARDKENNLESRVEYATYYIGAAKANGITCFWWDNHAFKGDGENFGLFDRKSCTIKYPEILQGLMKYAE

SEQ ID NO: 367 - protein, 743 aa, Clostridium phytofermentans
MKRKLKQRCAVLVAVATMIASLQWGRVPVQAVTADGLTSQQYVEAMGEGWNLGNSFDGFDSDTSKPDQGETAWGNPKVTKELIHAVKQKGYSSIRIPMTLYRRYTESNGVCTIDSAWIARYKEVVDYAVAEGLYVMINIHHDSWIWLSSWDGNKSSVQYVRFTQMWDQLAKAFKDYPLQVCFETINEPNFQNSGNVTAQNKLDMLNQAAYNIIRASGGSNAKRMIVLPSLNTNHDNSVPLADFITKLNDSNIIATVHYYSEWVFSANLGKTSFDEDLWGNGDYTPRDAVNKAFDTISNAFTAKKIGVVIGEFGLLGYDSDFENNQPGEELKYYEYMNYVARQKKMCLMFWDNGSGINRNDSKYSWKKPIVGKMLEVSMTGRSSYATGLDTIYLNGSSFNDINIPLTLNGNTFVGVTGLTSGTDFTYNQSNATLTLKSSYVKKVYDAMGSNYGTVADLVLKFSSGADWHEYLVKYKAPVFQNANGTVSNGINIPVQFNGSKLRRSTAYIGSNRVGPNQSWWMYLEYGATFVANYTNNILTIKPDFFKDGSVYDGNISFEMEFYDGQKLKYNLNKSNGNITGTAAAVTPTPTPTATPTPTATPTPTVTPKPTITPTVTPTPTVTPKPTITPTVTPTPTPIPGTGPVTLKYEVTNTWDKHTQANITLTNTSNTALKNFVVSFTYKGYIDQMWSADLVSQNSGTITVKGPAWATNLDPGQSITFGFIASHDTPSVDPPSNVTLVSSN

SEQ ID NO: 368 - protein, 468 aa, Clostridium phytofermentans
MSKIRRIVSLFLIVTIFITTCFFNVGQKVYAADTNNDDWLHCVGNKIYDMNGNEVWLTGANWFGFNCTENVFHGAWYDIKGMLTNIANRGIGFLRVPISTELLYSWMIGKPNKVSSVTAVNNPPYYVCNPDFYDPTTNSVKNSMEIFDIIMGYCKQLGIKVMVDVHSPDANNSGHNYPLWYGLTTTTAGEITTDKWINTQAWLADKYKNDDTILAFDIKNEPHGQRGYSTTTPTNIAKWDNSTDENNWKYAAERCAKAILAKNPKLLIMIEGVEQYPKTEKGYNYNTPDVWGATGDQSPWYSAWWGGNLRGVKDYPINIGTLNSQIVYSPHDYGPSVYNQPWFDKDFTTQTLLDDYWYNTWAYIKDKGIAPLLIGEWGGFMDGGKNQKWMTLLRDYIVNNRIHHTFWCINPNSGDTGGLLGYDWQTWDEAKYALLKPALWQSNGKFIGLDHQTPLGVNGISLGQYYGK

SEQ ID NO: 369 - protein, 972 aa, Clostridium phytofermentans
MGNASYLETPLWDNSLPLKKRLDYLVENLTLEEKFEFLGTGCPTIERLGIQSTFHGGEAAHGIEARHDQSFNKGEPEPTTIFPQPIGMSSTWDTTLLTKIGVTVGNEARVLYQRHKNGGLCRWAPTIDMERDPRWGRTEEAYGEDPYLTGKMASAYIQGMRGVDPFYIRCGATLKHFYANNTEKDRIFSSSSIDPRNKHEYYLEPFKRAITEGKAEAIMTAYNEINGVPCIVNNEVKNIVKEQWGLRGHVVCDGGDMMQTVSDHKYFGSHAETIAYGLKAGIDCFTDNREVVKQAAKEAYQAGLITEADLDTSICNSFSTRIRLGYFDAIGQNPYAHITEKYINSEENKSLTLEAATKAMVLLKNEGQILPLTKENSSFCVIGPLSDVWYKDWYSGIPPYSVTPLQGIKEYNKGTRKNLTNSKVVDGLPRVRIRYQEKYLCVTEEGFVTLGSKELAETFTITDWGNGNLTIATSQGKYLSADEEEGLITATKTEVFEWFVKEAFDFHLVGNLGEKSFQTIFEILSEQKRQEISVTIDTWKDDYVAINKEGKLSFSKEEKVTLDLELVSDGIEEAKEYTKNSDYAILVMGCNPVINSKEEIDRNDLDLPPYQERLIKQVHKVNPKVILVLITNYPYAIRWEKEHIPAIITTTSGSQELGNAIAAVLFGDVSPSGRLPMTWYLDTKDLPPIEDYDIIRGNRTYQYFNKEVLYPFGHGLTYTTMQYQKLTVQLEDFTNLLIKVTIANTGNRISDEVVQVYVRQEVSRTVRPRLQLKAFERVKNILPGEKREIEFIISTSDLTYYDVVNGGMILEESEYTILVGASSEDIRLRETAFIPGVKVGSRNLRKKILADHYDDCRNSYLHRGSLGDTAVVVKNKTEAAILLYRDVRIEEKPIKFHSTVQCVGEGSLIVSYIKQSDVASSEVKLGDITLENQDKFCDVIIPINWDRITCNEVITLKITLLEEMKLSSFYAE

SEQ ID NO: 370 - protein, 517 aa, Clostridium phytofermentans
MDLSIRGKVGQRIVAGFPGTTIDSELEDFIRTYKIGNFILFKENIVDANQLSNLCEGLQQLTKKYTGHRAFITIDQEGGMVTRLSEDSVNIPGAMAIAATRDEKNAYMAGRITGQQLRTLGFNFDLAPVADINSNMDNPVIGVRSYGDEPDQVAKYCVAMMKGLTDGGVLASAKHFPGHGDTNVDSHLGLPKVHKSLEEMELCELVSFKALIEAGIPAIMSSHIIFPALEEELPATMSRKIITGLLKEKLGFKGLVISDCMEMSAIKKYYGSIEGIKHAIEAGVDLIFVSHTMSVAREASDVLTGLYEKGELSMDEMDASIDKIMYYKDKCLCNENEKHDTNEFDVKAGIEFTKELLRKSLTPIQMPSDNLPVVDHNSLFLGCMPFRATNVFNIDAGAFQFADYMAKYFNGNGILTSPQPTDEEMEALIQPMKEASTVVIATYNAHLYKEQLKLVELAAKSNTNVIVFALRNPYDLKDLPANVYGIAVYEYTLKSVEALAEYMKQPYELSGKLPVKM

SEQ ID NO: 371 - protein, 520 aa, Clostridium phytofermentans
MLQKMNGKVKKILGISIAFLMLIMVIPTSIAKAATNKTYDFNSMTYQSTWGVTYSISNGSGTFNFTGQYREIKFNLPETLDMSQCTSVTFNASSPNGQIAFKLYDTSGNQVAVVYNFNSNTSDCTFAPNSTAKVNSIGIMAQGTNNYSAVVNRVTFTMTGGSSGTGSSTLLNTYGNILKNSGTAVNLSQLQNSNTLSVIKTQYNSITLENEMKPDAVLGSSSTLMTVAQAKSNGYYIPSSYTESTVPTLKFSTIDAVLQICYNNGLKLRGHTLVWHSQTPDWFFRTGYSSSGSYVSQAVMDARMEMFIRSYMSHIYNGSYGSVVYAWDVVNEYLHASTSGWSQVYGSNLGTTPSYVKKAFQYAYDCLSSFGLTNSVKLFYNDYNTYEVTDQILSLVNFINSGTKLCAGVGMQSHLNTSYPSVSAYKTAMQKFLNAGYEVQVTELDVTNTSASTQATYVYDLMTAILSLKKAGGNITGITWWGLYDSVSWRASQNPLLFSNLTTPKESYNKALQAFTDAGY

SEQ ID NO: 372 - protein, 756 aa, Clostridium phytofermentans
MFFKKLVALAMAVAIVIPMNVNNIQKVEAESTNEAVVYGNLIYHDFEASTNGWGPRGDNAEVVAQSTEEAYSGLHSLKISKRTQTWHGATCDLTKELTIGETYVFGIYLKYKGSSYSNTQKFSLQFQYNDGVNDQYKTIKTLEVTKDKWTLIQGEYTVPADAANAKVYVETEYKSSPSSQDLLDFYIDDFTATPATLPQIQKDIPSLKDVFSSYFFVGGAATAGEIAPAPAKDLVAKHYNRLTPGNELKPDSVLDYSATIAYMDANGGNQVNPQVNLRAAKTLLEYARDNNIPVRGHTLVWHSQTPDWFFKVNYSQDSNAAWVSKEVMLQRLENYIKNVMQLISSTYPTVKFYAWDVVNEAVDPNTSTGMRNPGSNNVTSGNSPWMQTIGEEYIQRAFEYARKYAPTGCKLFYNDYNEYEDRKSTFIFNILKGLKDKGLVDGMGMQSHWVMDYPSISMFETAVRKYNTLGLELQLTELDIKQPDNSTSALAAQADRYKLLINKVISLKKEGMNITGVIFWGVTDKTSWLGGYPLLFDGNYQAKSAYYSIIDGITPTVTPSITPTVTPKPTITPTVTPTVTPKPTITPTVTPTVTPKPTITPTITPTVTPKPTIAPTPTPTTVPVEGAKPVVVVTTKNNGNTISQQYTINALGGTIDLSKVSIEFTADGIINQEHNVWVDNAALQLTVEPYYTPLNGYVSGQLTNQKLVVSISKSTMLSEGTGKLVLDLRFAKKDWTDFGTISNEVLKVYYNGVKVQ

SEQ ID NO: 373 - protein, 212 aa, Clostridium phytofermentans
MFKLNKKVFALVSVIALGFSSLFTSTAHAATDYWQNWTDGGGTVNATNGSGGNYSVNWTNCGNFVVGKGWGTGNASRVVNYNAGVFSPSGNGYLTFYGWTRNSLIEYYVVDSWGTYRPTGTLKGTVSSDGGTYDIYTSTRTNAPSIDGTQTFQQYWSVRQSKRATGSNVAITFSNHVNAWKSKGMNLGSSWAYQALCVEGYQSSGSANVTVW

SEQ ID NO: 374 - protein, 806 aa, Clostridium phytofermentans
MGKKVIALLTCVMLSLTLIPGIGIKSTAQAAETNIYKVDWSKFNEGDKISGPMEGLGRSGGADITVTGSSTKSFYISNRKDNWDALDIQNDLLKLDRDATYEITVTGHVDSNVDTKNASVKLGGVTRKTGEDDGYPEFKKEKLQSGKSFVLTYELKLSDQIPDASRNLWVLRVQTDEPSGSRAGDLVPFYVDDIVIIQTKASTAPVAVTGDLMSLYELNADKTLKVGESLSSPALKVSGNAKIVVVEGTDGTVSLQLKDRVNNYDGVDILRDALKINDKFMSGTYTIEVKGHVEDGSDLSKSQFVMGMTESPWGELTSRVTPSSDGSFVITYTKAYTGSELTGLGYSYRVQTPPSVLTSFYIDNITVTVQGAEEEDESTVVIPEWDLTLDSIKDAYADYFMIGNIMEPGQIQDTETTEMFKHHYNVVTAENAMKPGNISKVKGEYNFDNADKLVTWAKENGLKVHGHTLVWHSQSAPWLTTNADGTPLTRAEARANMEDYIKNVAGHYAGKVISWDVLNEAFLPGVSEIPAGWRDVLRKFEDNGNGSPWYQAYENGADKSKGEDGSDYIYDAFVFTRLAAPDAVLYYNDFNETEAGKCEAIALMVEELNTKWKTDKRNTEPDRLLIEGIGMQAHYWTGDLKVSTVEASIKRFIKTGAKISVSELDVPHGDYMTYKQRTDSPTKEEEKLQADLYKQLFEVYKKYADNIERVTFWGKTDPQSWRFQGYPLLFDKNFAPKDAFFAVIDVAKEKVAEEKAVETIPGKDIPKTGEDSSKQMILTAVAILIILVFVPVTILTKRREKNIKNI

SEQ ID NO: 375 - protein, 381 aa, Clostridium phytofermentans
MNGAIKSGYYRNVFTELGYKEEDVTKKVEDSFQTLFYGLPEERIYYPVGEDLGYIVDTGNHDVRTEGMSYGMMMCLQLDKKEEFDRLWKWAKTYMFMDSGVNKGYFAWSCKTDGTKNSYGPAPDGEEYFALALFFASNRWGDGNGIFEYSKQARELLHECIHKGEEDGIGEPMWEPSNYLIKFIPNCNFTDPSYHLPHFYGLFALWAYEEDREFFKKAAEASRSYLKLACHEKTGLCAEYTEYDGTAHSGDQEIFGRHDWYYSDAYRTIANIGLDYLWFAADEWQVTCANHLQQFFCETVKEHASGIYQVDGTIIKGEALHPVAIIATNAQASLAANGPFAKECVDKFYHTELRTGDRRYYDNCLYMFALLALSGKYRMWM

SEQ ID NO: 376 - protein, 512 aa, Clostridium phytofermentans
MRQEYCNPVQRGFFPDPSVIRVGDDYYMVNSSFQYFPAIPISHSKDMVHWHIIGHAITNPEYLPLEDIKDSHGIWAPDISYHDGTFYIYATLRLNGSGTRGNNVLRRQLLVTSKTPEGPYSAPTWLEVDAIDPSHFVDDDGKHYMVIAKAATVIPLSDDGKRVIGEPFAAWTGTGECCPEGPHILKKDGYYYAIVAEGGTGYGHGINVARSKNLYGPYEECPYNPVLRQFKEDSPIQRTGHGKLVQTQNGDWWMYYLLGRPNQGRYTTVGRESGLDPVTWTEDGWFIVNEGKGPSERQIAPDLKPHVFERNLKDDFEEEKLNLDWEFVRNPDYGSCSSTERPGYFRIWTRDGRLDEIRAKNTLVRREQELSYEAETKVEFYPTKDGEQAGLTCYYSTATYARFSLCYEGGRKLQLVINRNHGEELMAEVLDIKERAVYLKVIVEKLTRSFYYSYDGKEWTLAGVLENCIYLCDEGVPDDPKRHTGTLVGIYANNGGCGSRIPADFDYFYYQE

SEQ ID NO: 377 - protein, 636 aa, Clostridium phytofermentans
MKLREAILNRDLDVVKDLLVKDPNSIEDKTGGVWLPFLAASLGDLEIVRYIVEYSRASFNETDELNRNVLHYGVESGNISVVRYLVERVGMSPVSGDINLVTPYEIAYENKNKEILTYFEEVCGAPYEQMYHNPIRTGMHPDPSIICVGDDFYMVNSSFIFFPCIPISHSKDLIHWKVIGHAITNPEWAYLDELEGGRGYWAPDISYYEGKYYITATYRLNDTGTVYRKQMVVSSDKPEGPYCEPVFLDEDGIDPSIFTDDDGRRYMLLNRGARIFEISKDGKKQLSEATLLYYGHQKRAPEGSHLLKKDGWYYLFQAEGGTGLGHRISVARSKELFGVYTPCPYNPIMRQQDEKGAIKRCGHGKPVKTPNGEWYMVYLCGRQLEGEYSLLGRETALDPITWTADGWPLVNNLEGPSVLQKLPNLTPYIPEPESDDFKNGILSSLWVSQRVPEENAYTFGNGYLKIQGSKKDLDTTESRNILLRRQQDFHFTFEVTVGDINLNIGQDYGLTCYYDENTYLKYGLFETKEGLFLQVVEHIDEETKISLSTKVTKGEYSLRIVTEGLKRSFYYQSIVDQEETNWHSLGQLDRVYYLCDEGINRGKRFTGAMVGMYAHAGENSSLTGEFKDIVYQGMDR

SEQ ID NO: 378 - protein, 499 aa, Clostridium phytofermentans
MKAKLTLSKISKIGTIDKRIYGSFIEHLGRAVYGGIYEPGHETSDDMGFRQDVMELIKELNIPIVRYPGGNFVSGYRWEDGIGDKAKRPRRLDLAWKSIETNEVGVDEFQEWAKRANSDVMMAVNLGTRGPQEAQDLIEYCNFQGGTYYSDLRRKNGFEKPFDIKVWCLGNEMDGPWQTCAKTAEEYGRIACETAKVMKWVDPSIELVACGSSGLTMPTFGDWERTVLEHTYDYVDYISLHQYYNNYENDPDVFLARSLEMETFIESVVAICDSVKAKKHSKKTINLSFDEWNVWFHSHGQDKRIEPWGKAPSLLEDVYTFEDALLVGCLLIALVKHCDRVKMACLAQLVNVIAPIMTENGGAAWAQTIFYPFMHVSNYGRGTALKPILECETYENKISDKVPYVETVAVHNEEKNEVVVFAVNRSADQTIDFSIDLTEFQNAKLVEHTEMIHADLKATNTASNPKNVVPSATGVTKIEENTAIATLKPYSWNVIRFSL

SEQ ID NO: 379 - protein, 728 aa, Clostridium phytofermentans
MIRGKKRVIAMAVSLWVVVAMLFTSVPGPLGSIIGTKSSTKVQAAEKFSTKLEAENGKMTGTVTVATTRPGYSGTGYVTGFTQNSSNSWSTSVVIPTTGHYTFTIRSAADSYKENYLYINGTQAGIIYSTGDGKWGDTVIESVYLEAGTITLSVKENWGWFDLDYIAIEAGSGVDNSVYQKATSTLVNPNANEKTKNIMAYLKSIYGKKTLAGQSCTLNASTEIEALYKATGKYPAIRMLDLIFCSPASDWHSTGEVDLALDWDKKGGLTTFQWHWHAPKGGASFYTDKTSFDLSKAVTSQNISRLPLADVKALYDSGKISEECYLMVRDIDAISGYLKQLQDAGVTVLWRPLHEASGGWFWWGAAGKDPYLWLYRLMFDRQTNYHKLNNLIWVWNGQDAAWYPGDAYCDIVGTDIYADNRNYSAQTAQFNKTVNYANGNKMAALSENGVMIDPALMTRDNTFWLWFAVWYGDFLIDYSGNLNGTYTEASMVKKVYNSNEVITLDKLPNFNGTTPTVTPTPTPTVKPTVTPTVTPTPTVKPTVTPTATPTATPTPTVKPTVTPTPTVTPSVTPIPGSFTLSLTNTGNNNLSTNTINADFKIKHEKGSDIDLSKLVIRYYYTKEGTAKENFYCDTAAMQLNKDPWYIPYTSVVNGTFNSMAVPKTKADSYLDVSFNTTDKLSADSTFIVNIRFTKSDWSLYNQENDYSYGDSTKVVVYYNGKLVLGVEP

SEQ ID NO: 380 - protein, 857 aa, Clostridium phytofermentans
MKGLVKKVSTFIIALSLLFSFITVPVSAGTALFVIESENTRLSSELQVVTAIYGQPKPGYSGAGFVWMQNSGTLTFDVTVPETGMYTISTRYMQELSTDGRLQYLSVNGINKGSFMLPYTTVWSDFNFGIYKLTKGSNTIQIKAGWGFAYFDTFTVDYAKLDSLNVAPTLTDSQATSETKLLMKYLTEVYGKHIISGQQEIYGGGNNGNSELEFDWIHNLTGKYPAIRGFDFMNYNPLYGWEDGTTNRIIDWVNNKNGIATGCWHITVPKDFNSYKLGDFVDWQKTTYKPTETNFKTANAVIPGTKEYQYVMLTIDDLAKQLLILQQNNVPIILRPYHEAEGNGGANGEGAWFWWASAGAKVYKQLWEMLYTRLTQTYGLHNIIWTYNSYVYSTSPAWYPGDNLVDIVGYDKYNTVYNRYDGLSGVPNEDAITTIFYQLVDLTNGKKMVAMTENDTVPSLQNLTEEKSGWLYFCPWYGEYLMSSANNYTKTLKELYQSNYVITLDELPNLKVDDQTPSSTITPTSITFDKYTPNQSDKTISIVFNGNTLNSLKLGTTTLKINVDYTLSGNNLILKKTFLSQLPTGESSIVFDFDKGKDPVLKVNVVDSTPSATITPVNATFDKAVDKQQNINVTVNLNGLSLVSVLNNSNKLLLNKDYTVSGNTIVLQKSYLSTLSLGESKLTFQFSAGNNPVLTLNVIDTTAPVITGNLVIQAFNGNTSASTNGISPKFKLINTGNTDINLSDIKLRYYYTIDGEISQNFWCDWASVGSENVKGEFVKLAKPVSGADYYLEISFTASAGTLKAGQNAEIQARFAKSNWSNYNQADDYSFNASSSQYVNSDKVTGYLSNKLVWGIEP

SEQ ID NO: 381 - protein, 532 aa, Clostridium phytofermentans
MRKQGFYLMCLLLGLSVNGCTSPGTSGESSNPKDVVVDTEVVNTETVNTDAACTDTPSTVLPFTTLSPTMIPIELEAEDAVLSGNVKIESSKSGFSGTGYISGFEDDSDYCEFKLTIEEDGFYDLNFISAALGGYKENYVLVDDENVGVAVTDQSKFSDSKLERIFLTNGTHNIKLSKFWGWVVVDKLIVTSSIELDTSIYEVPATLVNQNASDRTKRLMSYLTDIYGKKFLSGQYCEKGMYGTEISAIWKTTEGKFPAVLGLDLIDYTSSRVEKGSSSKAIQYAMEFDEKGGIVTFCWHWNAPTKYLTGTWYRGFYTEETNIDLVKIMNGQDDEGYQLLMNDIDAIAKELLKLKEADVPILWRPLHEASGGWFWWGAKGAEAYKKLYILLYEKLTNEYGLNNLIWLWNGQDKEWYPGDEYVDIIGEDIYPGEKVYTSQINKYLKAMNYTQAKKMVVLSENGCLFDPDLAIRDGAMWGFFATWGGEFVTKSALINWLSEQYTEEYMVKKVYAHDSVITLDKLPDLKNYPIYE

SEQ ID NO: 382 - protein, 818 aa, Clostridium phytofermentans
MISFENDVFWLDTDTTSYVFRITPYGHPEHIYYGRKLAHQPVDALALKRTATIGSSVLYEPNDPLYCLDHLSLEWSGIGRGDYRFSPAEIKMPDGSFTNDFIYDSYRIMDGCTPMEELPFAKSEDAQTLEIVLVDNVGHATLSLYYTVFSQTDVITRRCTLRNQGPNFQNKSHSLQQNDEQISTLQDSQSHLEVKNSCENEQHKESPIVIRRLMSMMVDLPNQSYQLITFDGDWIKEAHRHDRLLMPGMYVNGSVTGTSSNRHNPGFLLANERADETHGNVYGFNLIYSGNHFGGAELSPHGLVRVTLGINPHCFEWVLNPGESFSTPQAVMTFSDQGFHGMSRHFHDFINQHIVPEYWQNRERPILYNSWEAYFFKFNQRKLLHTAKHARSLGMELFVLDDGWFGKRNNDNAGLGDYEVNKKKFPHGISAFSRKIRKMGMEFGLWFEPEMVNEDSDLYRKHPDWAVHTPRRNPTYGRNQLVLDLCNPKVRDYIVESVGTVLDDAEVSYVKWDMNRHISDAYSRLLSEQGEFFHRYILGLYEILKRIFAPRPHILLETCSSGGNRFDLGMLCFGPQIWVSDCTDPVERLSIQGGLSFLYPPSTFGAHVSEAPHQQTLRQTPLATRFHTACFGCLGYELELKYLSKIERSEIREQIAFYKLHRPTLQFGKFRRLEPIKSNIIQWQCTEKDESKAIAGYFQTLANANPEHDILIVSDLNEKYNYQVTTKRQRLFIKRFGGLIKHVLPVSLNPDGFLLRLVNRFYALLDCTEEYIGDGRLLGSGILLNNQFMGSYYNFETRLLGDFGSNLYLIKQMESEVS

SEQ ID NO: 383 - protein, 930 aa, Clostridium cellulolyticum
MFRNINKRILAFAIVVAMLMSFIPTMAFAAEPDSSHLITSQAEKPSTAGALQILDKNGTKTLCDKDGNPIQLRGMSTHGLQWYPEIINDNAFAALSNDWGSNVIRIAMYVAEGGYSKDPETIKKRVIDGIDLAIANDMYAMLDWHVLTPGDPNADIYKGAMDFFKEISQKYPNNPHIIYELANEPSPNDPGVTNDAAGWAKVKSYAEPIIKMLRDSGNKNLVIVGSPNWSQRPDLAADNPINDNNTIYTVHFYSGTHKPSADSSDRGNVMSNARYALEHGVAVFASEWGTSEASGNNGPYLKEADEWLEFLNANNISWCNWSLTNKNETSGSFIPFISGKSDATSLDPGDDQVWSPKELSVSGEYARARIKGIKYEPIDRAEKEEFTTNVWDFNDGTTQGFGINGDSPVKADSITIANEKNTLKITGLNTSKDLTEGNYWANVRLSADGTSNKPNILGAEKLTMDIITAAPATVSIAAIPQNSTHGWANPTRAIAVKPADFVKQEDGTYKAVLTITPADSPNFDSIAKDSKDSTMTNIILFVGADTNVISLDNITVSGNRTTVEAPVEHAPIGKATLPSIFEDSTRQGWAWDAASGVQSALTIKDANGSKAISWEVKYPEVKPVDGWASAPRIMLSNINATRGNNKYLAFDFYLKPTQASKGSLSINLAFAPPTLGYWAQASVNFDIPLTKLSKMKKTKDGLYHFQVKYDLDKVNDGKVLAADTVLRDITIVVADGNSDFAGTMYVDNVRFENDSKSELNNAIAMLVSKGIIKSSDVKKINLNKSISRGEFLNWLVKTLDLNAKYSVNFSDVHKKDSYYNPVGIAKALGITNGVGHNKFNPNKAISREDMLVLTFKALKLVNKNLVKGNADDLKQFTDASKVSRNSVESISTIVKNGFYSGDAKKLNLKASVSKAETALMLYKIYTSLHK

SEQ ID NO: 384 - protein, 740 aa, Clostridium cellulolyticum
MVSFTSLLAGVAAISGVLAAPAAEVEPVAVEKREAEAEAASSPANKVYQDRFESMYSKIKDPANGYFSEQGIPYHSIETLMVEAPDYGHVTTSEAMSYYMWLEAMHGRFSGDFTGFDKSWSVTEQYLIPTEKDQPNTSMSRYDANKPATYAPEFQDPSKYPSPLDTSQPVGRDPINSQLTSAYGTSMLYGMHWILDVDNWYGFGARADGTSKPSYINTFQRGEQESTWETIPQPCWDEHKFGGQYGFLDLFTKDTGTPAKQFKYTNAPDADARAVQATYWADQWAKEQGKSVSTSVGKATKMGDYLRYSFFDKYFRKIGQPSQAGTGYDAAHYLLSWYYAWGGGIDSTWSWIIGSSHNHFGYQNPFAAWVLSTDANFKPKSSNGASDWAKSLDRQLEFYQWLQSAEGAIAGGATNSWNGRYEAVPSGTSTFYGMGYVENPVYADPGSNTWFGMQVWSMQRVAELYYKTGDARAKKLLDKWAKWINGEIKFNADGTFQIPSTIDWEGQPDTWNPTQGYTGNANLHVKVVNYGTDLGCASSLANTLTYYAAKSGDETSRQNAQKLLDAMWNNYSDSKGISTVEQRGDYHRFLDQEVFVPAGWTGKMPNGDVIKSGVKFIDIRSKYKQDPEWQTMVAALQAGQVPTQRLHRFWAQSEFAVANGVYAILFPDQGPEKLLGDVNGDETVDAIDLAILKKYLLNSSTTINTANADMNSDNAIDAIDYALLKKALLSIQGGGSGGGS

SEQ ID NO: 385 - protein, 501 aa, Clostridium cellulolyticum
MNKIKISDKVTGSFRDNWNFCVGTERMGIALQKEYQDTLEFVQKAINFKYIRGHGLFHDDTAIYREYEIDGEMKPFYNFTYIDRIFDSFLEKGLKPFVELGFMPSQLASGGQTVFYWKGNVTPPKDYDKWKNLIQALIKHFISRYGIEEVLQWPFEVWNEPNLKVFWKDADESEYFKLYKVSATAIKEINKDLQVGGPAICGGADYWIKDFLEFCKRENVPVDFVSRHLYSAHMPKLQTHEFCYQDLKEPEEMLKELQTVRQMIDNSPFPHLPFHITEYNTSYNPLNPVHDTCLNAAYLARIISEAGDIVDSFSYWTFSDVFEEADVPRAQFHGGFGLVALNNIPKPTFHMFSFFEQMGKDILYRDENMLATRKADGTVTITAWNPVMEKGDHFNMDFSLELNLPKGEYFINRTIVNETHGNPWRTWIQMGRPRFPGKKQVEILRNAARPMVISERVSCTDEILLLEFTQSKNEVSFIEIIPVADETNTYYKLDDSLIPGY

SEQ ID NO: 386 - protein, 591 aa, Clostridium cellulolyticum
MNWKNTIISLTLAGSFIFTMSSCTSKPVSSNVPEVTNQAVTSMSQDLKAENEISDDVHVNQLGYKTLSKKIAVIKGQYKKFQVVDSKTGVAVLTGDLTGNPKDESSGDTVCYADFSKITVPGKYFISISGLGKSYDFLIDDNVYSKLGDAMLKALCYQRCGTALTPDFAGEYSHAECHKTLAKFYNDETREIDVSGGWHDAGDYGRYVVPATVTVAGLLLAYEFYPQVFTDAVRIPESGNKIPDVLDEAKYGIEWLLKMQDSESGGVYHKVTSRVFPEMTTMPDKDVDNQLVMSISTNATADFAAVTAMASRIYVTIDPVFSQNCLQASQKAWEWLEKNKDFVSFKNPSDVASGEYGDSSGKDEKAWAAAELFRATGNEKYNEYFTDNYQIEGFGLGWQNVSGFAAIAYMFSDVSGTDQKKVDEIKKAWLDKADMFASTGQKDGYLVAMHKMEYNWGSNMNVATHAMHLLISDRLKTDDKYIHTAEDCTHYLLGRNTLNQSYITGFGSKQVKKPHHRPSAADLALNPVPGLMVGGPDSALEDDVAKSKLSGKFPAECYIDDINSFSTNEVATYWNSPVIFILGYLNSNRLL

SEQ ID NO: 387 - protein, 904 aa, Clostridium cellulolyticum
MVSFTSLLAGVAAISGVLAAPAAEVEPVAVEKREAEAEALVGAGDLIRNHTFDNRVGLPWHVVESYPAKASFEITSDGKYKITAQKIGEAGKGERWDIQFRHRGLALQQGHTYTVKFTVTASRACKIYPKIGDQGDPYDEYWNMNQQWNFLELQANTPKTVTQTFTQTKGDKKNVEFAFHLAPDKTTSEAQNPASFQPITYTFDEIYIQDPQFAGYTEDPPEPTNVVRLNQVGFYPNADKIATVATSSTTPINWQLVNSTGAAVLTGKSTVKGADRASGDNVHIIDFSSYTTPGTDYKIVTDVSVTKAGDNESMKFNIGDDLFTQMKYDSMKYFYHNRSAIPIQMPYCDQSQWARPAGHTTDILAPDPTKDYKANYTLDVTGGWYDAGDHGKYVVNGGIATWTVMNAYERALHMGGDTSVAPFKDGSLNIPESGNGYPDILDEARYNMKTLLNMQVPAGNELAGMAHHKAHDERWTALAVRPDQDTMKRWLQPPSTAATLNLAAIAAQSSRLWKQFDSAFATKCLTAAETAWDAAVAHPEIYATMEQGAGGGAYGDNYVLDDFYWAACELYATTGSDKYLNYIKSSKHYLEMPTELTGGENTGITGAFDWGCTAGMGTITLALVPTKLPAADVATAKANIQAAADKFISISKAQGYGVPLEEKVISSPFDASVVKGFQWGSNSFVINEAIVMSYAYEFSDVNGTKNNKYINGALTAMDYLLGRNPNIQSYITGYGDNPLENPHHRFWAYQADNTFPKPPPGCLSGGPNSGLQDPWVKGSGWQPGERPAEKCFMDNIESWSTNEITINWNAPLVWISAYLDEKGPEIGGSVTPPTNLGDVNGDGNKDALDFAALKKALLSQDTSTINVANADINKDGSIDAVDFALLKSFLLGKITLGGGSGGGS

SEQ ID NO: 388 - protein, 496 aa, Clostridium cellulolyticum
MVSFTSLLAGVAAISGVLAAPAAEVEPVAVEKREAEAEAYDASLIPNLQIPQKNIPNNDGMNFVKGLRLGWNLGNTFDAFNGTNITNELDYETSWSGIKTTKQMIDAIKQKGFNTVRIPVSWHPHVSGSDYKISDVWMNRVQEVVNYCIDNKMYVILNTHHDVDKVKGYFPSSQYMASSKKYITSVWAQIAARFANYDEHLIFEGMNEPRLVGHANEWWPELTNSDVVDSINCINQLNQDFVNTVRATGGKNASRYLMCPGYVASPDGATNDYFRMPNDISGNNNKIIVSVHAYCPWNFAGLAMADGGTNAWNINDSKDQSEVTWFMDNIYNKYTSRGIPVIIGECGAVDKNNLKTRVEYMSYYVAQAKARGILCILWDNNNFSGTGELFGFFDRRSCQFKFPEIIDGMVKYAFEAKTDPDPVIVYGDYNNDGNVDALDFAGLKKYIMAADHAYVKNLDVNLDNEVNAFDLAILKKYLLGMVSKLPSNGGGSGGGS

SEQ ID NO: 389 - protein, 874 aa, Clostridium cellulolyticum
MKKRVLKKIAMLMVIVFVLSSCALQAFAVEYEGAGDLIRNHTFDNGVGFPWRVVESYPATADYDITADGKYKITITKIGAAGIGQRWDVQFLHRGLSLVNGHTYTIKFTVTASRACKIYPKIGDQGDPYEEYWNMNQQWQFLELQANVPKTVTATFIQTKGDKKNVEFAFHLAPDICTSEAQNPASFQPITFTFDDIYVADPQFAGYPAPIPEPTNVVRLNQEGFYPNADKIATVVSSSTTPINWQLVNSAGTAVLTGKSTVKGADHASGDNVHIIDFSSYKTAGTGYKIVTDVPVTNIGDNGSMPFNISNDIYSKMKYDSMKYFYHNRSGIPIKMPFCDQPQLARPAGHTNDILAPDPTKDYRANYTLDVTGGWYDAGDFGKYVVKGGISTWTLMNSYERALYLGDTSVVPFIDGSLNIPESGNGFPDILDEARYNLNTLLNMQVPTGNTLAGMVHYKAGDERWLQLAIRPDQDTMKRYLQPPSTAATLNLAAIAAQGSRLWKQYDAAFATKCLTAAETAWDAAVEHPDKYIYINSVTGIGTNGENYFLDDFYWAACELYATTGSNKYLNYINSSPHYLQEPSELTAGDMGFTGCFDLDNTAGMGTITLALVPNGLPAADIAKAKANIQTAADKFISIEKAQGYGVPIEEKVISSRFDQSTVSGFPCGSNSFVINEAIVMSYAYLFSNKNTKYINGAITAMDYILGRNPNVQSYVTGYGDNPLENPHHRFWAYQADNSFPHPPAGCMSGGPNSGLQDSWVKSLGWQPGKVASEKCFLDNIESWSTNEIAINWNAPLAWVSAFLDEEGRVICGGDTLGDINGDGQRDALDFALIKKALLNGDTSIQNADVNNDGSVDAMDLALYKSFLLGKVNF

SEQ ID NO: 390 - protein, 737 aa, Clostridium cellulolyticum
MVSFTSLLAGVAAISGVLAAPAAEVEPVAVEKREAEAEAAGTYNYGEALQKSIMFYEFQRSGDLPADKRDNWRDDSGMKDGSDVGVDLTGGWYDAGDHVKFNLPMSYTSAMLAWSLYEDKDAYDKSGQTKYIMDGIKWANDYFIKCNPTPGVYYYQVGDGGKDHSWWGPAEVMQMERPSFKVDASKPGSAVCASTAASLASAAVVFKSSDPTYAEKCISHAKNLFDMADKAKSDAGYTAASGYYSSSSFYDDLSWAAVWLYLATNDSTYLDKAESYVPNWGKEQQTDIIAYKWGQCWDDVHYGAELLLAKLTNKQLYKDSIEMNLDFWTTGVNGTRVSYTPKGLAWLFQWGSLRHATTQAFLAGVYAEWEGCTPSKVSVYKDFLKSQIDYALGSTGRSFVVGYGVNPPQHPHHRTAHGSWTDQMTSPTYHRHTIYGALVGGPDNADGYTDEINNYVNNEIACDYNAGFTGALAKMYKHSGGDPIPNFKAIEKITNDEVIIKAGLNSTGPNYTEIKAVVYNQTGWPARVTDKISFKYFMDLSEIVAAGIDPLSLVTSSNYSEGKNTKVSGVLPWDVSNNVYYVNVDLTGENIYPGGQSACRREVQFRIAAPQGRRYWNPKNDFSYDGLPTTSTVNTVTNIPVYDNGVKVFGNEPAGGSENPDPEILYGDVNSDKNVDALDFAALKKYLLGGTSSIDVKAADTYKDGNIDAIDMATLKKYLLGTITQLPQGGGGSGGGS

SEQ ID NO: 391 - protein, 606 aa, Clostridium cellulolyticum
MVSFTSLLAGVAAISGVLAAPAAEVEPVAVEKREAEAEAINSQDMVKKMGIGMNLGNTFDAPTEGSWSKAAQEYYFDDFKQAGFKHVRIPIRWDQHTLANSPYTVDSNFLNRIETVIDWSLSRGFVTVINSHHDTWLMDNYSQNIGRFEKIWEQIAQRFKGKSENLVFEILNEPHGNITDSQINDMNKRILNIIRKTNPTRNVIIGAGYWNSYNSLSQLEIPNDPNLIATFHYYDPYSFTHQWQGTWGTKNDMDAIAMVFNHVKKWSDKNNIPVYLGEYGVMGHSDRTSAVKWFDFVSDQAISHGFSCGAWDNGVFGSVDNDMAFYNRDTRQFDKEILNAILTTGTTYDWTPPTETNPDPPRTPATPAYGEQLIEDFEGAMQWAAYSGVDATASCKISSGKSNNGLEITYAGSSNGYWGVVDNEHRNQDWEKWQKISFDIKSSNTNEVRLLIAEQSKIEGEDGEHWTYVIKPSTSWTTIEIPFSSFTKRMDYQPPAQDGSETFDLYKVGSLHFMYSNSNSGTLNIDNIKLIGLPEEQIGGKIGDVNEDGNIDAIDFALLKKYLLDSSISINKVNADINLDGDINAIDFAKLKMMLLGDGGGSGGGS

SEQ ID NO: 392 - protein, 475 aa, Clostridium cellulolyticum
MVSFTSLLAGVAAISGVLAAPAAEVEPVAVEKREAEAEAADQIPFPYDAKYPNGAYSCLADSQSIGNNLVRSEWEQWKSAHITSNGARGYKRVQRDATTNYDTVSEGLGYGLLLSVYFGEQQLFDDLYRYVKVFLNSNGLMSWRIDSSGNIMGKDSIGAATDADEDIAVSLVFAHKKWGTSGGFNYQTEAKNYINNIYNKMVEPGTYVIKAGDTWGGSNVTNPSYFAPAWYRIFADFTGNSGWINVANKCYEIADKARNSNTGLVPDWCTANGTPASGQGFDFYYDAIRYQWRAAIDYSWYGTAKAKTHCDAISNFFKNIGYANIKDGYTISGSQISSNHTATFVSCAAAAAMTGTDTTYAKNIYNECVKVKDSGNYTYFGNTLRMMVLLYTTGNFPNLYTYNSQPKPDLKGDVNNDGAIDALDIAALKKAILTQTTSNISLTNADMNNDGNIDAIDFAQLKVKLLNGGGSGGGS

SEQ ID NO: 393 - protein, 395 aa, Thermobifida fusca
MGLPVSVHRSDTKMRVGRYIAITVGASALLVSGVAPAAAGTLPTSGTAAGAASQAGHDQKQVPLRKVAPKGFAIGVAVAGGGHHLDQEYPDPFKYDEEYRGVLAKHFNSVTPENHLKWDFVHPERKKYNFGPADQIVKFAQSNGQKVRGHTLVWHSQNPDWLTKGKFSKKELRKILKEHIITVVGRYRGKIHQWDVANEIFDDNGKLRTNENIWLKNFGPEIIADAFRWAHQADPKAKLFLNDYGAEGINKRSDAYLKFMKELRKKGVPVHGFGVQGHLSLAYPFPGDMAKNLKRFSDAGFEVAVTEVDVRIPLNGGDATEAQLKTQADYYRRALEACLSVKSCNSFTLWGTTNKYSWVPVFFPDEGEATIFWDDFSPKPAYTALQEALAKARRR

SEQ ID NO: 394 - protein, 338 aa, Thermobifida fusca
MNHAPASLKSRRRFRPRLLIGKAFAAALVAVVTMIPSTAAHAAVTSNETGYHDGYFYSFWTDAPGTVSMELGPGGNYSTSWRNTGNFVAGKGWATGGRRTVTYSASFNPSGNAYLTLYGWTRNPLVEYYIVESWGTYRPTGTYMGTVTTDGGTYDIYKTTRYNAPSIEGTRTFDQYWSVRQSKRTSGTITAGNHFDAWARHGMHLGTHDYMIMATEGYQSSGSSNVTLGTSGGDNPGGGNPPGGGNPPGGGGCTATLSAGQQWNDRYNLNVNVSGSNNWTVTVNVPWPARIIATWNIHASYPDSQTLVARPNGNGNNWGMTIMHNGNWTWPTVSCSAN

SEQ ID NO: 395 - protein, 441 aa, Thermobifida fusca
MSPRPLRALLGAAAAALVSAAALAFPSQAAANDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 396 - protein, 619 aa, Thermobifida fusca
MGRMTPLTRRLRAGAAAIAIGASALIPLTSSPAAASGTADWLHTDGNRIVDSAGNEVWLTGANWFGFNTSERMFHGLWAANIEDITSAMAERGINIVRVPISTQLLLEWKNGQAGPSGVNEYVNPELAGMNTLEVFDYWLQLCEEYGLKVMLDVHSAEADNSGHYYPVWYKGDITTEDFYTAWEWVTERYKNNDTIVAADIKNEPHGKANETPRAKWDGSTDIDNFKHVCETAGKRILAINPNMLILCEGIEIYPKDGQDWSSTDGRDYYSTWWGGNLRGVADHPVDLGAHQDQLVYSPHDYGPSVFEQPWFEGEWNRQTLTEDVWRPNWLYIHEDDIAPLLIGEWGGFLDGGDNEKWMTALRSLIIDEKLHHTFWALNPNSGDTGGLLNYDWTTWDEAKYAFLKPALWQDANGKFVGLDHDVPLGGVGSTTGVSLNQYYGGGGPSQPPTEPTEPPTEPTEPPTEPTEPPANPTGALEVYYRNNSLAADDSQIAPGLRLVNTGSSTVDLADVEIHYYFTNEPGGTLQFTCDWAQVGCANVNASFTSLSAPGADTSLVLTLSGSLAPGASTELQGRIHTANWANFDESDDYSRGTNTDWELSEVITAYLGGTLVWGTPPA

SEQ ID NO: 397 - protein, 928 aa, Thermobifida fusca
MTEPFRDPTLPPHERVRDLLARLTTEEKIGLLHQYQRPIPRLGIASFRTGTEALHGLAWHGPATVFPQAIGLASTWDPDLVQQVGAATAAEVLVFHTKNPATVGRNVWAPVVNPLRDPRWGRNEEGYSEDPWLTGVMAVSYARGLAGPHPHRMDTAPTLKHFLAYNNETDRCTSSSHLPPRVLHEYELPAFLPALREGVAVAVMPSYNLVNGRPAHLSPLINDVLRAAAPDELMVVSDAMAPGNLVDPQHYYDDHATAYAHALRAGIDSFTQDDDRAEATLAHLRDALDRGLITEEDLDRAATHILSVRVRLGEFDPEPLRRVDPDTVNSPAHQALARTAARRSIVLLKNDGILPLRDPRRIAVIGQLADTLMEDWYSGTLPYAITARAGLAERTETVFCEGVDRIALRTNEGYLTASADGTPMTITPAPGFGPVAESAAFDLFDWGGAWALRAVVNGRYVSEDENGHLTNDQPGPNGWEVRQTFRWQPDPNGTGVLQHIATGRYVAVGDNNTVTLTPDADSAAVFAIDTLRSGATEAAAIAATAEVAIVVAGDHPLVNGRETEDRTDLDLPAAQEKVLRAVRAANPATVLVLTSGYPFGIVWADEHIPAILWSAHGGQEYGRALADVLFGDADPTGRLTQTWYRSAAELPDLFDYDIIANDATYLYYLGSPLYPFGHGLSYTTFDYTDPEVHVTDDHVTVHVTVTNTGDRFGEEVVQCYTHQRVSRVKQPLRKLQGFARVALHPGETRRVRIDFPIHALAIWDVTRSRFVVEDAPRTVHLGRSAKDLRVCAPLNVPGEPIGPRPATRLHAADNDEYHGVVLCAAAKDRGDAVRATEPGAWIAFLDVDFTPAPKEAVICANTDQPGTLTLRIDNPISGPTVATADIPAATDHFDFTEVRIPVDSVTRRHDLYIVFEAAGTALSWIDLS

SEQ ID NO: 398 - protein, 463 aa, Thermobifida fusca
MSNDHLPEFPAGFWFGAATASYQIEGAVHADGRGPSIWDTYSHTPGLVLNGDTGDVACDHYHRYPEDVELLRRLGVDAYRFSIAWPRVMPTGSGDVNQRGLDFYDRLVDALLEAGITPVPTLYHWDLPQALEDAGGWRSRSTAEHFAAYTRAVVARLGDRIRHWITLNEPFCSAFLGYAVGRHAPGAREGTPALAAAHHLLLAHGLAVQELRAADAGEVGITLNPDRILPASDSAADRAAADRAETLHNRVWFDPLFAGRYPANEADVWGELADGSYRRDGDLEIIGQPLDFLGINYYRPLKVADGPLTEADPARRTAVDIRAHQQRFDGVRHTAMDWPVVPESFTDLLLDLTERYPNLPPIYITENGSAEHDVVSPDGRVHDTDRIAYLNDHLHALAAAIRAGVDVRGYFVWSLLDNFEWAFGYERRFGIVRVDYDTLERLPKDSYFWYQRLIEHHRARHRG

SEQ ID NO: 399 - protein, 984 aa, Thermobifida fusca
MRSLLSPRRWRTLASGALAAALAAAVLSPGVAHAAVACSVDYDDSNDWGSGFVAEVKVTNEGSDPIQNWQVGWTFPGNQQITNGWNGVFSQSGANVTVRYPDWNPNIAPGATISFGFQGTYSGSNDAPTSFTVNGVTCSGSQPANLPPDVTLTSPANNSTFLVNDPIELTAVASDPDGSIDRVEFAADNTVIGIDTTSPYSFTWTDAAAGSYSVTAIAYDDQGARTVSAPIAIRVLDRAAVIASPPTVRVPQGGTADFEVRLSNQPSGNVTVTVARTSGSSDLTVSSGSQLQFTSSNWNQPQKVTIASADNGGNLAEAVFTVSAPGHDSAEVTVREIDPNTSSYDQAFLEQYEKIKDPASGYFREFNGLLVPYHSVETMIVEAPDHGHQTTSEAFSYYLWLEAYYGRVTGDWKPLHDAWESMETFIIPGTKDQPTNSAYNPNSPATYIPEQPNADGYPSPLMNNVPVGQDPLAQELSSTYGTNEIYGMHWLLDVDNVYGFGFCGDGTDDAPAYINTYQRGARESVWETIPHPSCDDFTHGGPNGYLDLFTDDQNYAKQWRYTNAPDADARAVQVMFWAHEWAKEQGKENEIAGLMDKASKMGDYLRYAMFDKYFKKIGNCVGATSCPGGQGKDSAHYLLSWYYSWGGSLDTSSAWAWRIGSSSSHQGYQNVLAAYALSQVPELQPDSPTGVQDWATSFDRQLEFLQWLQSAEGGIAGGATNSWKGSYDTPPTGLSQFYGMYYDWQPVWNDPPSNNWFGFQVWNMERVAQLYYVTGDARAEAILDKWVPWAIQHTDVDADNGGQNFQVPSDLEWSGQPDTWTGTYTGNPNLHVQVVSYSQDVGVTAALAKTLMYYAKRSGDTTALATAEGLLDALLAHRDSIGIATPEQPSWDRLDDPWDGSEGLYVPPGWSGTMPNGDRIEPGATFLSIRSFYKNDPLWPQVEAHLNDPQNVPAPIVERHRFWAQVEIATAFAAHDELFGAGAP

SEQ ID NO: 400 - protein, 438 aa, Thermobifida fusca
MRMRSRLAAFGALAGLTATLAAVTPAEDAYAHGAMTYPPTRSYICYVNGIEGGQGGNIAPTNPACQNLLAENGNYPFYNWFGNLISDAGGRHREIIPDGQLCGPHPQFSGLNLVSEHWPTTTLVAGSTITFQYNAWAPHPGTWYLYVTKDGWDPNSPLGWDDLEPVPFHTVTDPPIRPGGPEGPEYYWDATLPNKSGRHIIYSIWQRSDSPEAFYDCTDVVFVGGGDDGGSGGPQPDTEAPTAPGTPVAGSLNGTSAQISWPAATDNVGVAEYRVYNAANDELLATTRTTSVTLTGLTPNTDYSIYVVARDAAGNTSSPSATLTFNSGDAPALACEIEYSTPNTWYGGFTAQVRIYNGSHESIDGWELTWDFTNGETINQAWNATAQQSGTTVTVTNVSWNSTIPHHGSVEFGFNANSTREPGVPENFKLNGSLCSVA

SEQ ID NO: 401 - protein, 596 aa, Thermobifida fusca
MSKVRATNRRSWMRRGLAAASGLALGASMVAFAAPANAAGCSVDYTVNSWGTGFTANVTITNLGSAINGWTLEWDFPGNQQVTNLWNGTYTQSGQHVSVSNAPYNASIPANGTVEFGFNGSYSGSNDIPSSFKLNGVTCDGSDDPDPEPSPSPSPSPSPTDPDEPGGPTNPPTNPGEKVDNPFEGAKLYVNPVWSAKAAAEPGGSAVANESTAVWLDRIGAIEGNDSPTTGSMGLRDHLEEAVRQSGGDPLTIQVVIYNLPGRDCAALASNGELGPDELDRYKSEYIDPIADIMWDFADYENLRIVAIIEIDSLPNLVTNVGGNGGTELCAYMKQNGGYVNGVGYALRKLGEIPNVYNYIDAAHHGWIGWDSNFGPSVDIFYEAANASGSTVDYVHGFISNTANYSATVEPYLDVNGTVNGQLIRQSKWVDWNQYVDELSFVQDLRQALIAKGFRSDIGMLIDTSRNGWGGPNRPTGPSSSTDLNTYVDESRIDRRIHPGNWCNQAGAGLGERPTVNPAPGVDAYVWVKPPGESDGASEEIPNDEGKGFDRMCDPTYQGNARNGNNPSGALPNAPISGHWFSAQFRELLANAYPPL

SEQ ID NO: 402 - protein, 466 aa, Thermobifida fusca
  misc_feature (11)..(11): Xaa can be any naturally occurring amino acid
MAKSPAARKGXPPVAVAVTAALALLIALLSPGVAQAAGLTATVTKESSWDNGYSASVTVRNDTSSTVSQWEVVLTLPGGTTVAQVWNAQHTSSGNSHTFTGVSWNSTIPPGGTASSGFIASGSGEPTHCTINGAPCDEGSEPGGPGGPGTPSPDPGTQPGTGTPVERYGKVQVCGTQLCDEHGNPVQLRGMSTHGIQWFDHCLTDSSLDALAYDWKADIIRLSMYIQEDGYETNPRGFTDRMHQLIDMATARGLYVIVDWHILTPGDPHYNLDRAKTFFAEIAQRHASKTNVLYEIANEPNGVSWASIKSYAEEVIPVIRQRDPDSVIIVGTRGWSSLGVSEGSGPAEIAANPVNASNIMYAFHFYAASHRDNYLNALREASELFPVFVTEFGTETYTGDGANDFQMADRYIDLMAERKIGWTKWNYSDDFRSGAVFQPGTCASGGPWSGSSLKASGQWVRSKLQS

SEQ ID NO: 403 - protein, 616 aa, Thermobifida fusca
MTPLTRRLRAGAAAIAIGASALIPLTSSPAAASGTADWLHTDGNRIVDSAGNEVWLTGANWFGFNTSERMFHGLWAANIEDITSAMAERGINMVRVPISTQLLLEWKNGQAGPSGVNEYVNPELAGMNTLEVFDYWLQLCEEYGLKVMLDVHSAEADNSGHYYPVWYKGDITTEDFYTAWEWVTERYKNNDTIVAADIKNEPHGKANETPRAKWDGSTDIDNFKHVCETAGKRILAINPNMLILCEGIEIYPKDGQDWSSTDGRDYYSTWWGGNLRGVADHPVDLGAHQDQLVYSPHDYGPSVFEQPWFEGEWNRQTLTEDVWRPNWLYIHEDDIAPLLIGEWGGFLDGGDNEKWMTALRSLIIDEKMHHTFWALNPNSGDTGGLLNYDWTTWDEAKYAFLKPALWQDANGKFVGLDHDVPLGGVGSTTGVSLNQYYGGGGPSQPPTEPTEPPTEPTEPPTEPTEPPANPTGALEVYYRNNSLAADDSQIAPGLRLVNTGSSTVDLADVEIHYYFTNEPGGTLQFTCDWAQVGCANVNASFTSLSAPGADTSLVLTLSGSLAPGASTELQGRIHTANWANFDESDDYSRGTNTDWELSEVITAYLGGTLVWGTPPA

SEQ ID NO: 404 - protein, 974 aa, Thermobifida fusca
MLRRPRSRSPLVALTAATCRVALGGTAVPAQADEVNQIRNGDFSSGTAPWWGTENIQLNVTDGMLCVDVPGGTVNPWDVIIGQDDIPLIEGESYAFSFTASSTVPVSIRALVQEPVEPWTTQMDERALLGPEAETYEFVFTSNVDWDDAQVAFQIGGSDEPWTFCLDDVALLGRAEPPVYEPDTGPRVRVNQVGYLPHGPKKATVVTDATSALTWELADADGNVVASGQTKPHGADSSSGLNVHTVDFSSYTTKGSDYTLTVDGETSYPFDIDESVYEELRVDALSFYYPQRSGIEILDSIAPGYGRPAGHIGVPPNQGDTDVPCAPGTCDYSLDVSGGWYDAGDHGKYVVNGGISVHQIMSIYERSQLADTAQPDKLADSTLRLPETGNGVPDVLDEARWEMEFLLKMQVPEGEPLAGMAHHKIHDEQWTGLPLLPSADPQPRYLQPPSTAATLNLAATAAQCARVFEPFDEDFAAECLAAAETAWDAAKANPNIYAPAFGEGGGPYNDNNVTDEFYWAAAELFLTTGKEEYRDAVTSSPLHTDDEEVFRDGAFDWGWTAALARLQLATIPNDLADRDRVRQSVVDAADMYLANVETSPWGLAYKPNNGVFVWGSNSAVLNNMVILAVAFDLTGDTKYRDGVLEGMDYIFGRNALNQSYVTGYGDKDSRNQHSRWYAHQLDPRLPNPPKGTLAGGPNSDSTTWDPVAQSKLTGCAPQMCYIDHIESWSTNELTINWNAPLSWIASFIADQDDAGEPGGEEPGPGDDETPPSKPGNLKASDITATSATLTWDASTDNVGVVGYKVSLVRDGDAEEVGTTAQTSYTLTGLSADQEYTVQVVAYDAAGNLSTPATVTFTTEKEDETPTPSASCAVTYQTNDWPGGFTASVTLTNTGSTPWDSWELRFTFPSGQTVSHGWSANWQQSGSDVTATSLPWNGSVPPGGGSVNIGFNGTWGGSNTKPEKFTVNGAVCSIG

SEQ ID NO: 405 - protein, 441 aa, Thermobifida fusca; identical to SEQ ID NO: 395

SEQ ID NO: 406 - protein, 998 aa, Thermobifida fusca
MGALPWWASAVRSSSQFESPYGRTSVLRRPRSRSPLVALTAATCAVALGGTAVPAQADEVNQIRNGDFSSGTAPWWGTENIQLNVTDGMLCVDVPGGTVNPWDVIIGQDDIPLIEGESYAFSFTASSTVPVSIRALVQEPVEPWTTQMDERALLGPEAETYEFVFTSNVDWDDAQVAFQIGGSDEPWTFCLDDVALLGGAEPPVYEPDTGPRVRVNQVGYLPHGPKKATVVTDATSALTWELADADGNVVASGQTKPHGADSSSGLNVHTVDFSSYTTKGSDYTLTVDGETSYPFDIDESVYEELRVDALSFYYPQRSGIEILDSIAPGYGRPAGHIGVPPNQGDTDVPCAPGTCDYSLDVSGGWYDAGDHGKYVVNGGISVHQIMSIYERSQLADTAQPDKLADSTLRLPETGNGVPDVLDEARWEMEFLLKMQVPEGEPLAGMAHHKIHDEQWTGLPLLPSADPQPRYLQPPSTAATLNLAATAAQCARVFEPFDEDFAAECLAAAETAWDAAKANPNIYAPAFGEGGGPYNDNNVTDEFYWAAAELFLTTGKEEYRDAVTSSPLHTDDEEVFRDGAFDWGWTAALARLQLATIPNDLADRDRVRQSVVDAADMYLANVETSPWGLAYKPNNGVFVWGSNSAVLNNMVILAVAFDLTGDTKYRDGVLEGMDYIFGRNALNQSYVTGYGDKDSRNQHSRWYAHQLDPRLPNPPKGTLAGGPNSDSTTWDPVAQSKLTGCAPQMCYIDHIESWSTNELTINWNAPLSWIASFIADQDDAGEPGGEEPGPGDDETPPSKPGNLKASDITATSATLTWDASTDNVGVVGYKVSLVRDGDAEEVGTTAQTSYTLTGLSADQEYTVQVVAYDAAGNLSTPATVTFTTEKEDETPTPSASCAVTYQTNDWPGGFTASVTLTNTGSTPWDSWELRFTFPSGQTVSHGWSANWQQSGSDVTATSLPWNGSVPPGGSVNIGFNGTWGGSNTKPEKFTVNGAVCSIG

SEQ ID NO: 407 - protein, 477 aa, Clostridium thermocellum
MKNVKKRVGVVLLILAVLGVYMLAMPANTVSAAGVPFNTKYPYGPTSIADNQSEVTAMLKAEWEDWKSKRITSNGAGGYKRVQRDASTNYDTVSEGMGYGLLLAVCFNEQALFDDLYRYVKSHFNGNGLMHWHIDANNNVTSHDGGDGAATDADEDIALALIFADKLWGSSGAINYGQEARTLINNLYNHCVEHGSYVLKPGDRWGGSSVTNPSYFAPAWYKVYAQYTGDTRWNQVADKCYQIVEEVKKYNNGTGLVPDWCTASGTPASGQSYDYKYDATRYGWRTAVDYSWFGDQRAKANCDMLTKFFARDGAKGIVDGYTIQGSKISNNHNASFIGPVAAASMTGYDLNFAKELYRETVAVKDSEYYGYYGNSLRLLTLLYITGNFPNPLSDLSGQPTPPSNPTPSLPPQVVYGDVNGDGNVNSTDLTMLKRYLLKSVTNINREAADVNRDGAINSSDMTILKRYLIKSIPHLPY

SEQ ID NO: 408 - protein, 938 aa, Clostridium thermocellum
MKLRYKVRRRRRIITCCGIIAAVIVVSTLIITIKNSFKPSRQSSNSNVTYSKENVQSVYSDRFIALFEDIQKQGYLSEEGIPYHSIETLLVEAPDYGHLTTSEAMSYMVWLGATYGKLTGDWTYFKDAWDKTEQYIIPDPERDQPGVNSYIPTQPAQYAPEADSPEKYPTPGDINAPTGIDPIADELASTYGTKAIYQMHWLLDVDNWYGYGNHGDGTSRCSYINTYQRGSGESVWETIPHPSWEDFRWGQVNNGGFLKLFGNFGEPVRQWRYTSASDADARQIQATYWAYLWSKEQGKEKELQPYFEKAAKMGDYLRYTFFDKYFRPIGVQDSGRAGTGYDSCHYLLSWYASWGGDINGTWSWRIGSSHCHQGYQNPMAAYALAKESIFTPKSKNAKKDWEQSLDRQIELFLYLQSAEGAIAGGVTNSWSGAYGKYPEGTSTFYDMAYDPHPVYNDPPSNRWFGFQAWSMERIMEYYYLTGDSRVKELCKKWVSWAIENTRLKSDGTYEIPSTLEWSGQPDPWTGKPSENKNLHCTVTEWTVDVGVTASYAKALIYYAAATEKHEKKIDDKARETAKQLLDRMWHNYRDKKGVAAKEPRADYKRFFDEVYIPHDFSGINAQGAEIKNGITFIDLRPKYKEDKDYKMVEEAIKSGKDPVMTYHRYWAQAEVAMANAMYHIFFEQKKDGLVPGINSDDSNSSSETQKSETPDYTPDSLSTSDATITESPANTNSPDENPSPQNTSAPTNVPLNPANTPYNSSNAAPNSPNTPARPSNTTAGSPAGNNTVGRLILQYANGNGSDTTNTINPRFKLINNSGSPVKLSDVKIRYYYTIDGEKGQQFWCDWSSAGNSNVTGKFVKLTSPKNNADYYLEIGFTEGAGSIEPGMSVEVQARFSKDDWSNYSQANDYSFSASANDYGNSNHIALYISGRLVSGNEP

SEQ ID NO: 409 - protein, 710 aa, Clostridium thermocellum
MVKKTLCFVLTLAMLTAFILPQGIVSAAGSYNYAEALQKAIYFYECQQAGPLPEWNRVEWRGDATMNDEVLGGWYDAGDHVKFNLPMAYSAAMLGWALYEYGDDIEASGQRLHLERNLAFALDYLVACDRGDSVVYQIGDGAADHKWWGSAEVIEKEMTRPYFVGKGSAVVGQMAAALAVGSIVLKNDTYLRYAKKYFELADATRSDSTYTAANGFYSSHSGFWDELLWASTWLYLATGDRNYLDKAESYIPKLNRQNQTTDIEYQWAHCWDDCHYGAMILLARATGKEEYHKFAQMHLDWWTPQGYNGKRVAYTPGGLAHLDTWGPLRYATTEAFLAFVYADSINDPALKQKYYNFAKSQIDYALGSNPDNRSYVVGFGNNPPQRPHHRTAHGTWLDKRDIPEKHRHVLYGALVGGPGRDDSYEDNIEDYVKNEVACDYNAGFVGALCRLTAEYGGTPLANFPPPEQRDDEFFVEAAINQASDHFTEIKALLNNRSSWPARLIKDLSYNYYMDLTEVFEAGYSVDDIKVTIGYCESGMDVEISPITHLYDNIYYIKISYIDGTNICPIGQEQYAAELQFRIAAPQGTKFWDPTNDFSYQGLTRELAKTKYMPVFDGATKIFGEVPGGFEPVPSPSPTPAQYKVGDLNGDGVVNSTDSVILKRHIIKFSEITDPVKLKAADLNGDGNINSSDVSLMKRYLLRIIDKFPVE

SEQ ID NO: 410 - protein, 343 aa, Clostridium thermocellum
MVSFKAGINLGGWISQYQVFSKEHFDTFITEKDIETIAEAGFDHVRLPFDYPIIESDDNVGEYKEDGLSYIDRCLEWCKKYNLGLVLDMHHAPGYRFQDFKTSTLFEDPNQQKRFVDIWRFLAKRYINEREHIAFELLNEVVEPDSTRWNKLMLEYIKAIREIDSTMWLYIGGNNYNSPDDLKNLADIDDDYIVYNFHFYNPFFFTHQKAHWSESAMAYNRTVKYPGQYEGIEEFVKNNPKYSFMMELNNLKLNKELLRKDLKPAIEFREKKKCKLYCGEFGVIAIADLESRIKWHEDYISLLEEYDIGGAVWNYKKMDFEIYNEDRKPVSQELVNILARRKT

SEQ ID NO: 411 - protein, 561 aa, Clostridium thermocellum
MKCRYMDYLINCELDSLPNEKSEKINKHISTCMDCRNYLGALMISKKYIAKEPEMDKYFYMRVINAIDPDRYKKSKLTFKILSSLERLKPAFKASLGTLAIFVAVALLITGGIFDNLGNWIAKSSNNRSNTGETTNLTFLRTDGQNIVTGTGEIFHIRGVTLTNNFWGNWVNGESEKLQSQGMDPIIRPLVQDAWVLTDDDFERIKDLGCNTVLYDINYQLFAEDNPNREENLKKLKEHIRRFSSMDIYTAVMLMAPPGLDSINDAYEKYKHGSERIKSVFEDDTYYEQWVEMWKYLAEELKDFKGVAGYGLINQPRAPSESEGGIGIFRERLNNVCREIRKIDKNHIIFVPEYNSREANPGESYWNEKTNSYVIDNGEQGIIWERGLVKVDSSNVVYLFHFFEPYNFVNDGVGDFDAESLEAQVRKRYEWAKNVGRAPLLTEYGISRVNSVDKRVQWLETVHDIFDKYGISASYFQYKNAVGAFINVKTGFNALYGEYVSWDSEIGLNPFYFVNEHVATSAKENHFDEALKEYYLKGKNLKKISILDNQPILETLQNFWK

SEQ ID NO: 412 - protein, 760 aa, Clostridium thermocellum
MIVGKVLDMDEKTAIIMTDDFAFLNVVRTSEMAVGKKVKVLDSDIIKPKNSLRRYLPVAAVAACFVIVLSFVLMFINGNTARKNIYAYVGIDINPSIELWINYNNKIAEAKALNGDAETVLEGLELKEKTVAEAVNEIVQKSMELGFISREKENIILISTACDLKAGEGSENKDVQNKIGQLFDDVNKAVSDLKNSGITTRILNLTLEERESSKEENISMGRYAVYLKAKEQNVNLTIDEIKDADLLELIAKVGIDNENVPEDIVTEDKDNLDAINTGPAESAVPEVTETLPATSTPGRTEGNTATGSVDSTPALSKNETPGKTETPGRTFNTPAKSSLGQSSTPKPVSPVQTATATKGIGTLTPRNSPTPVIPSTGIQWIDQANERINEIRKRNVQIKVVDSSNKPIENAYVEAVLTNHAFGFGTAITRRAMYDSNYTKFIKDHFNWAVFENESKWYTNEPSMGIITYDDADYLYEFCRSNGIKVRGHCIFWEAEEWQPAWVRSLDPFTLRFAVDNRLNSAVGHFKGKFEHWDVNNEMIHGNFFKSRLGESIWPYMFNRAREIDPNAKYFVNNNITTLKEADDCVALVNWLRSQGVRVDGVGVHGHFGDSVDRNLLKGILDKLSVLNLPIWITEYDSVTPDEYRRADNLENLYRTAFSHPSVEGIVMWGFWERVHWRGRDASIVNDNWTLNEAGRRFESLMNEWTTRAYGSTDGSGSFGFRGFYGTYRITVTVPGKGKYNYTLNLNRGSGTLQTTYRIP

SEQ ID NO: 413 - protein, 448 aa, Clostridium thermocellum
MSKITFPKDFIWGSATAAYQIEGAYNEDGKGESIWDRFSHTPGNIADGHTGDVACDHYHRYEEDIKIMKEIGIKSYRFSISWPRIFPEGTGKLNQKGLDFYKRLTNLLLENGIMPAITLYHWDLPQKLQDKGGWKNRDTTDYFTEYSEVIFKNLGDIVPIWFTHNEPGVVSLLGHFLGIHAPGIKDLRTSLEVSHNLLLSHGKAVKLFREMNIDAQIGIALNLSYHYPASEKAEDIEAAELSFSLAGRWYLDPVLKGRYPENALKLYKKKGIELSFPEDDLKLISQPIDFIAFNNYSSEFIKYDPSSESGFSPANSILEKFEKTDMGWIIYPEGLYDLLMLLDRDYGKPNIVISENGAAFKDEIGSNGKIEDTKRIQYLKDYLTQAHRAIQDGVNLKAYYLWSLLDNFEWAYGYNKRFGIVHVNFDTLERKIKDSGYWYKEVIKNNGF

SEQ ID NO: 414 - protein, 754 aa, Clostridium thermocellum
MAVDIKKIIKQMTLEEKAGLCSGLDFWHTKPVERLGIPSIMMTDGPHGLRKQREDAEIADINNSVPATCFPSAAGLACSWDRELVERVGAALGEECQAENVSILLGPGANIKRSPLCGRNFEYFPEDPYLSSELAASHIKGVQSQGVGACLKHFAANNQEHRRMTVDTIVDERTLREIYFASFENAVKKARPWVVMCAYNKLNGEYCSENRYLLTEVLKNEWMHDGFVVSDWGAVNDRVSGLDAGLDLEMPTSHGITDKKIVEAVKSGKLSENILNRAVERILKVIIMALENKKENAQYEQDAHHRLARQAAAESMVLLKNEDDVLPLKKSGTIALIGAFVKKPRYQGSGSSHITPTRLDDIYEEIKKAGADKVNLVYSEGYRLENDGIDEELINEAKKAASSSDVAVVFAGLPDEYESEGFDRTHMSIPENQNRLIEAVAEVQSNIVVVLLNGSPVEMPWIDKVKSVLEAYLGGQALGGRWRMCYSVKSIVGKLAETFPVKLSHNPSYLNFPGEDDRVEYKEGLFVGYRYYDTKGIEPLFPFGHGLSYTKFEYSDISVDKKDVSDNSIINVSVKVKNVGKMAGKEIVQLYVKDVKSSVRRPEKELKGFEKVFLNPGEEKTVTFTLDKRAFAYYNTQIKDWHVESGEFLILIGRSSRDIVLKESVRVNSTVKIRKRFTVNSAVEDVMSDSSAAAVLGPVLKEITDALQIDMDNAHDMMAANIKNMPLRSLVGYSQGRLSEEMLEELVDKINNVE

SEQ ID NO: 415 - protein, 503 aa, Clostridium thermocellum
MKKARMTVDKDYKIAEIDKRIYGSFVEHLGRAVYDGLYQPGNSKSDEDGFRKDVIELVKELNVPIIRYPGGNFVSNYFWEDGVGPVEDRPRRLDLAWKSIEPNQVGINEFAKWCKKVNAEIMMAVNLGTRGISDACNLLEYCNHPGGSKYSDMRIKHGVKEPHNIKVWCLGNEMDGPWQVGHKTMDEYGRIAEETARAMKMIDPSIELVACGSSSKDMPTFPQWEATVLDYAYDYVDYISLHQYYGNKENDTADFLAKSDDLDDFIRSVIATCDYIKAKKRSKKDIYLSFDEWNVWYHSNNEDANIMQNEPWRIAPPLLEDIYTFEDALLVGLMLITLMKHADRIKIACLAQLINVIAPIVTERNGGAAWRQTIFYPFMHASKYGRGIVLQPVINSPLHDTSKHEDVTDIESVAIYNEEKEEVTIFAVNRNIHEDIVLVSDVRGMKDYRLLEHIVLEHQDLKIRNSVNGEEVYPKNSDKSSFDDGILTSMLRRASWNVIRIGK

SEQ ID NO: 416 - protein, 481 aa, Clostridium thermocellum
MKHKGIVLKLTKSKAIISTNDFQCYYIKRSPTIYVGKEVEFTNKDIVTKKSVLIKPALSVACFILLIACVLSLSKIINNISPKVFAYISVDINPSFEIEIDDMGNVLNLLPLNDDAKVIADKLEIDKINVSNAIDIIINEAIKSNVINENEKDFILVSSTLNIKKEENSQQYQSEKEKLDIIINSLKDSIEKSGKADVYIVQADVNEREAARSKGISTGRYVLYNKYKDLENDLSLEDAKDADVNVLIKSMLDVASEERNPEESPKMTPTPTPTHTATHTPTDAPTPKPANTPTSTPAAKPSPKTASNSASTSTPAPKPTSTPTPTLMPTPTPTPTPADKIAYGQFMKFESSNYRGYYIRVKSFSGRIDPYVNPVEDSMFKIVPGLADPSCISFESKTYPGYYLKHENFRVILKKYEDTDLFREDATFRVVPGWADENMISFQSYNYPYRYIRHRDFELYIENIKTDLDRKDATFIGIKVD

SEQ ID NO: 417 - protein, 887 aa, Clostridium thermocellum
MRLVNSLGRRKILLILAVIVAFSTVLLFAKLWGRKTSSTLDEVGSKTHGDLTAENKNGGYLPEEEIPDQPPATGAFNYGEALQKAIFFYECQRSGKLDPSTLRLNWRGDSGLDDGKDAGIDLTGGWYDAGDHVKFNLPMSYSAAMLGWAVYEYEDAFKQSGQYNHILNNIKWACDYFIKCHPEKDVYYYQVGDGHADHAWWGPAEVMPMERPSYKVDRSSPGSTVVAETSAALAIASIIFKKVDGEYSKECLKHAKELFEFADTTKSDDGYTAANGFYNSWSGFYDELSWAAVWLYLATNDSSYLDKAESYSDKWGYEPQTNIPKYKWAQCWDDVTYGTYLLLARIKNDNGKYKEAIERHLDWWTTGYNGERITYTPKGLAWLDQWGSLRYATTTAFLACVYSDWENGDKEKAKTYLEFARSQADYALGSTGRSFVVGFGENPPKRPHHRTAHGSWADSQMEPPEHRHVLYGALVGGPDSTDNYTDDISNYTCNEVACDYNAGFVGLLAKMYKLYGGSPDPKFNGIEEVPEDEIFVEAGVNASGNNFIEIKAIVNNKSGWPARVCENLSFRYFINIEEIVNAGKSASDLQVSSSYNQGAKLSDVKHYKDNIYYVEVDLSGTKIYPGGQSAYKKEVQFRISAPEGTVFNPENDYSYQGLSAGTVVKSEYIPVYDAGVLVFGREPGSASKSTSKDNGLSKATPTVKTESQPTAKHTQNPASDFKTPANQNSVKKDQGIKGEVVLQYANGNAGATSNSINPRFKIINNGTKAINLSDVKIRYYYTKEGGASQNFWCDWSSAGNSNVTGNFFNLSSPKEGADTCLEVGFGSGAGTLDPGGSVEVQIRFSKEDWSNYNQSNDYSFNPSASDYTDWNRVTLYISNKLVYGKEP

SEQ ID NO: 418 - protein, 895 aa, Clostridium thermocellum
MNFRRMLCAAIVLTIVLSIMLPSTVFALEDKSPKLPDYKNDLLYERTFDEGLCFPWHTCEDSGGKCDFAVVDVPGEPGNKAFRLTVIDKGQNKWSVQMRHRGITLEQGHTYTVRFTIWSDKSCRVYAKIGQMGEPYTEYWNNNWNPFNLTPGQKLTVEQNFTMNYPTDDTCEFTFHLGGELAAGTPYYVYLDDVSLYDPRFVKPVEYVLPQPDVRVNQVGYLPFAKKYATVVSSSTSPLKWQLLNSANQVVLEGNTIPKGLDKDSQDYVHWIDFSNFKTEGKGYYFKLPTVNSDTNYSHPFDISADIYSKMKFDALAFFYHKRSGIPIEMPYAGGEQWTRPAGHIGVAPNKGDTNVPTWPQDDEYAGRPQKYYTKDVTGGWYDAGDHGKYVVNGGIAVWTLMNMYERAKIRGIANQGAYKDGGMNIPERNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPSADIQKARNNIAKAADKWLENIEEQGYRLPIKQAEDERGGYPWGSNSFILNQMIVMGYAYDFTGNSKYLDGMQDGMSYLLGRNGLDQSYVTGYGERPLQNPHDRFWTPQTSKKFPAPPPGIIAGGPNSRFEDPTITAAVKKDTPPQKCYIDHTDSWSTNEITINWNAPFAWVTAYLDEIDLITPPGGVDPEEPEVIYGDCNGDGKVNSTDAVALKRYILRSGISINTDNADVNADGRVNSTDLAILKRYILKEIDVLPHK

SEQ ID NO: 419 - protein, 649 aa, Clostridium thermocellum
MSRMTLKSSMKKRVLSLLIAVVFLSLTGVFPSGLIETKVSAAKITENYQFDSRIRLNSIGFIPNHSKKATIAANCSTFYVVKEDGTIVYTGTATSMFDNDTKETVYIADFSSVNEEGTYYLAVPGVGKSVNFKIAMNVYEDAFKTAMLGMYLLRCGTSVSATYNGIHYSHGPCHTNDAYLDYINGQHTKKDSTKGWHDAGDYNKYVVNAGITVGSMFLAWEHFKDQLEPVALEIPEKNNSIPDFLDELKYEIDWILTMQYPDGSGRVAHKVSTRNFGGFIMPENEHDERFFVPWSSAATADFVAMTAMAARIFRPYDPQYAEKCINAAKVSYEFLKNNPANVFANQSGFSTGEYATVSDADDRLWAAAEMWETLGDEEYLRDFENRAAQFSKKIEADFDWDNVANLGMFTYLLSERPGKNPALVQSIKDSLLSTADSIVRTSQNHGYGRTLGTTYYWGCNGTVVRQTMILQVANKISPNNDYVNAALDAISHVFGRNYYNRSYVTGLGINPPMNPHDRRSGADGIWEPWPGYLVGGGWPGPKDWVDIQDSYQTNEIAINWNAALIYALAGFVNYNSAQNEVLYGDVNDDGKVNSTDLTLLKRYVLKAVSTLPSSKAEKNADVNRDGRVNSSDVTILSRYLIRVIEKLPI

SEQ ID NO: 420 - protein, 654 aa, Clostridium stercorarium
MKRKVKKMAAMATSIIMAIMIILHSIPVLAGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITVDGGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYNNVNFANGLSSITARVATQISTSIQVRAGGATGTLLGTIYVPSTNSWDSYQNVTANLSNITGVHDITLVFSGPVNVDYFVFTPANVNSGPTSPVGGTRSAFSNIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKFRNLRV

SEQ ID NO: 421 - protein, 387 aa, Clostridium stercorarium
MNKFLNKKWSLILTMGGIFLMATLSLIFATGKKAFNDQTSAEDIPSLAEAFRDYFPIGAAIEPGYTTGQIAELYKKHVNMLVAENAMKPASLQPTEGNFQWADADRIVQFAKENGMELRFHTLVWHNQTPTGFSLDKEGKPMVEETDPQKREENRKLLLQRLENYIRAVVLRYKDDIKSWDVVNEVIEPNDPGGMRNSPWYQITGTEYIEVAFRAAREAGGSDIKLYINDYNTDDPVKRDILYELVKNLLEKGVPIDGVGHQTHIDIYNPPVERIIESIKKFAGLGLDNIITELDMSIYSWNDRSDYGDSIPDYILTLQAKRYQELFDALKENKDIVSAVVFWGISDKYSWLNGFPVKRTNAPLLFDRNFMPKPAFWAIVDPSRLRE

SEQ ID NO: 422 - protein, 1032 aa, Clostridium stercorarium
MNGRNGGKRPIASLLVLTLAFLFIPVTKAETTVYHETFAEGKGAAVQSGGATITHVTGKFFDGNGDGAALYISNRVNNWDAADFRFSDIGLQDGRIYKITVKGYVDPDVHVPEGSQIWLQTVNSYGWWGSTDIKAGEAFTLTGVYKVDTTNDYALRIQSNDTGAFVPFYIGEILITEETVPQDDSRNGNKTHAEKFTPITFEDQTTGGFTGRAGTEILTVTDEANHTDGGRYSLKVGGRNDTWHGPALGVEKYVDQGYEYKVAVYVRLISPESAQLQLSTQIGEGTSASYVNLAKKNVAISDGWVLLEGTYRYDNLGGGYLTIYVESPDSPEASFYIDDINFEPTGMKSEEIEKGLKSLKDVYKDNFLTGTAISLRDLEGVRFELLKKHFNAVTAENAMKPSELQREKGNFTFDGADRLVNAAISAGMKVHGHTLVWHQQTPAWMNIKLDSGGNIVYLSREEALENMRNHIRTVIEHFGDKVISWDVVNEAMSDNPSNPSDWRGSLRKSPWYYAIGEDYVEQAFLAAREVLDEHPEWDIKLYYNDYNLDNQNKALAVYNMVRELNEKYQKTHPGKLLIDGIGMQGHYSVNTNPKNVELSLKRFTELGVEVSISELDIRAGSNYQLTEKEANAQAYLYAQLFKIFREYSDSIARVTFWGMDDGTSWRAEESPLLFDRTLKAKPAYYAVADPDEFIEKYKPETIEANRAYAVYGTPEIDGKTDEVWNKAPELKINRYQTAWHGADGTARVLYDENNLYVLIKVNDTQLDKGSPNPWEQDSVEIFIDENNAKTSFYEEDDGQYRVNFENETSFNPESIAGGFESAAEVSGTNYTLEVKIPFRTVKPVSNMQIGFDVQINDGKNGVRQSIATWNDPTGNAWQDTSVFGILTLKSKNPVTRGEAIVKIMKAYDMEPLENWNDNFSDASGSYAGYYPRAKETGFVSGIGDNKIGAEIPLTREMFFTMIYNIERITGKMQGIDISDAELTLFSDYNDLSEWAEEAVKALVKSGRIKINGDLLPKRLMDAEEVEAFLRLR

SEQ ID NO: 423 - protein, 715 aa, Clostridium stercorarium
MENKPVYLDPSYSFEERAKDLVSRMTIEEKVSQMLYNSPAIERLGIPAYNWWNEALHGVARAGTATMFPQAIGMAATFDEELIYKVADVISTEGRAKYHASSKKGDRGIYKGLTFWSPNINIFRDPRWGRGQETYGEDPYLTARLGVAFVKGLQGNHPKYLKAGGMCKNILPFTVVPESLRHEFNAVVSKKDLYETYLPAFKALVQEAKVESVMGAYNRTNGEPCCGSKTLLSDILRGEWGFKGHVVSDCWAIRDFHMHHHVTATAPESAALAVRNGCDLNCGNMFGNLLIALKEGLITEEEIDRAVTRLMITRMKLGMFDPEDQVPYASISSFVDCKEHRELALDVAKKSIVLLKNDGLLPLDRKKIRSIAVIGPNADSRQALIGNYEGTASEYVTVLDGIREMAGDDVRIYYSVGCHLYKDRVENLGEPGDRIAEAVTCAEHADVVIMCLGLDSTIEGEEMHESNIYGSGDKPDLNLPGQQQELLEAVYATGKPIVLVLLTGSALAVTWADEHIPAILNAWYPGALGGRAIASVLFGETNPSGKLPVTFYRTTEELPDFTDYSMENRTYRFMKNEALYPFGFGLSYTTFDYSDLKLSKDTIRAGEGFNVSVKVTNTGKMAGEEVVQVYIKDLEASWRVPNWQLSGMKRVRLESGETAEITFEIRPEQLAVVTDEGKSVIEPGEFEIYVGGSQPDARSVRLMGKAPLKAVLRVQ

SEQ ID NO: 424 - protein, 500 aa, Clostridium stercorarium
MAREITIPAAGKPFKNNATFCVGSGRLGLALQKEYIDHLKIVQERIHFKYIRGHGLFCDDVGIYRETEEDGKHVAYYNFTYLDRIIDSFLEHDIRPFLELGFMPEKLKSGEQTIFYWKGNTTPPVSYEKWAELVETTLAHLIDRYGAEEVITWPVEVWNEPNIAFWAGTMEEYFKLYEYSAKRERVDPNKVGGPVICGIETEKWLRAFFEHCIENNLPLDFVSRHCYTVGKPVRKGQFIYHEIFSPTYMIEELKETRKIMADYPQIANLPLHITEFNSSYVPVCPVHDTTFQAAYIARILSEAGEYADSYSYWTFSDVFEEYDVPRSAFHGGFGLVALNSIKKPVFHTFEFFANAGKELLYRDENLIVTRDDKRYVIIGWNYHDTRKGEPGPDKEYVLSIPSIGQQAILIKKQVGGNYANPLQTWSNLGKPRTLNKEQRKILMAASEPLQTDVKLFDEKGFYKVKLTIQCNHLYMLEILPVKDFTDTYDGFEPDEFFGLE

SEQ ID NO: 425 - protein, 754 aa, Clostridium stercorarium
MQRDIKKIISQMTLEEKASLCSALDAWTLKGVERLGIPSIMVSDGPHGLRKRQRDPTDPGKKTTVPATCFPTAVGLASSWNRELVEKVGPALGEECQAEGIAVLLGPGTNIKLSPLSGRNFEYFSEDPYLSSEMARSHIKGVQSRGVGTSLKHFAANNQEHRRMSVDAVIDERTLREIYLASFEGAVKKAKPWTIMCSYNRVNGEYASENKFLLTDVLRNEWGFEGIVVSDWGAVNERVKGLEAGLDLEMPSSFGIGDQKIVEAVKKGELPEEVLDRTVERILNLIFKAVDNRKENAGYDREAHHKLAREAARECMVLLKNEDKILPLRKQGTIAVIGEFAKRPRYQGGGSSHVNPTIMDSPYEEIKKSAGNNADVIYAQGYIIEKDEPDEKLLEEAKQTALKADVAVIFAGLPEHYECEGYDRTHMRMPESHCTLIEEVAEVTTNVVVVLCNGSPVEMPWIDKVKGLLEAYLGGQAMGGPLPIFCSETPIPGKLAETFPKQLSDNPSYLNFRERDRVEYREGIFVGYRYYDKKNMEPLFPFGYGLSYTTFEYGDLKISRKEISDNETVTVSVKVKNTGDMAGKEIVQLYVRDIETSVIDRRRTEGFEKVELQPGEEKTVVFELDKRAFAYTHRYKDWHVETGEFRDFIGRSSRDIVLKDKIFVKSTVTIKKRWTVNTLVGDLLSDRVLEPVFREFIINEIKTWYLLDLLDEDNHLLSVWMRYTPLRSLANSTGGELNEEKLNRLIDTLNANIK

SEQ ID NO: 426 - protein, 487 aa, Clostridium stercorarium
MSTTTDPYKGWAPLTHVKKTRGWIDPCPFWDDHGNAYLVRVSEKAGLGSRDPASVPGESDGTCLLDEGVHIFDGNLNHHTIEGAKMYKRNGYYYIFAPAGGVKTGWQTVLRSKNIYGPYEDRIVMHQGKTNVNGPHQGGWVETQTGEHWFIHFQDRGPYGRIVHLQPMVWVDDWPVIGKDTENCGTGEPVDVYKKPDVGGVFPVQVPETSDDFDKNKLGLQWQWNANPQEKWYSLTERDGFLRLYALNNSNESGLLYHAPNILTQLFQAPEFTASAKLEFSPAQTGDKAGLVILGDEYMYLTIEKTEEANKVACIYGSPSENGYREEVLESRTAESTTVIFRVDVRNGAVCSFSFSYDRENFVNAGRDFNATAGSWVGAKLGIFAMNTYSDSKGFADFDWVIVGKPVVPAEDNIVSRGDIMKKYDNNYGVRMCDSVIKRHRLLPVKWSYDYGVYLRVWKKSGLKQAMKNISGTLRTIWIFTWIPTDI

SEQ ID NO: 427 - protein, 491 aa, Clostridium stercorarium
MAKYVINTLNRKSKINREIYGHFSEHLGRCIYGGFYVGENSPIPNTKGIRNDVVNALKKIRIPVLRWPGGCFADEYHWMDGIGPKEQRKKMINTHWGGVVEASFGTDEFMELCRQLECEPYINGNLGSGTVKEMQDWIEYLTFDGISPMSELRAKNGRKEPYRLKYFCIGNENWGCGGNMRPEFYADMYRRYQTYVRNYGNNKIYKIACGPNSDDYNWTETVVKIAGRFMDAISLHYYTVPGTWHSKGSSTKFTEEEWYITLFKTLKMDELITKHTAIIRRYDPDNRIGLVVDEWGTWYDVEPGTNPGFLYQQNTMRDALVAGINLNIFNKHSDKVVMANLAQTINVLQAVILTEGEKMLLTPTYHVFDMYKEHQGAELVEKLLLKTEKKSAQTKYTVPNLHESASVNADGKLHITLCNLSLSESYRVETEIIGKKAENVTGRILTGKMNDHNTFDAPETVKPQTFDKISVRQNGLVIEIPPVSVVSITVD

SEQ ID NO: 428 - protein, 946 aa, Clostridium stercorarium
MRKFWSFAIIISLLVTGLFIHTPKAEAAGYNYGEALQKAIMFYEFQRSGKLPENKRDNWRGDSGLNDGADVGLDLTGGWYDAGDHVKFNLPMAYSQTMLAWAAYEAEEALERSGQMGYLLDAIKWVSDYLIKCHPSPNVFYYQVGDGHLDHSWWGPAEVMQMDRPAYKVDLANPGSTVVAEAAAALASAAVVFADRDPAYAATCIQHAKELYNFAEITKSDSGYTAASGFYDSHSGFYDELSWAGVWLYLATGDETYLNKAEQYVAYWGTEPQTNIISYKWAHCWDDVHYGACLLLAKITGKQIYKEAIERHLDYWSVGYNGERVHYTPKGLAWLDSWGSLRYATTTAFLASVYADWEGCSREKAAIYNDFAKQQIDYALGSSGRSYVVGFGVNPPKRPHHRTAHSSWADSMSVPDYHRHVLIGALVGGPGKDDSYTDDINNYINNEVACDYNAGFVGALAKMYEDYGGSPIPDLNAFEEITNDEFFVMAGINASGQNFIEIKALLHNQSGWPARVADKLSFRYFVDLTELIEAGYSASDVTITTNYNAGAKVTGLHPWNEAENIYYVNVDFTGTKIYPGGQSAYRKEVQFRIAAPQNTNFWNNDNDYSFRDIKGVTSGNTVKTVYIPVYDDGVLVFGVENGIKYGNTYLREGTDYTVSGDTVTILKSFLNSFDTSTVQLIFDFSAGRDPVLTVNIIDTTTSASIVPTTADFDKNPDASRDVKVKLVPNGNTLLAVKKDGEALVLGRDYSIDGDEVTIFREYLADQPVGRVTLTFDFDRGTDPVLTINITDSRQVETGVIQIQMFNGNTSDKTNGIMPRYRLTNTGTTPIRLSDVKIRYYYTIDGEKDQNFWCDWSSVGSNNITGTFVKMAEPKEGADYYLETGFTDGAGYLQPNQSIEVQNRFSKADWTDYIQTNDYSFSTNTSYGSNDRITVYISGVLVSGIEP

SEQ ID NO: 429 - protein, 914 aa, Clostridium stercorarium
MKRRLMKGISLLTLVFLIGIMLQLSLKSELTAYASSDDPYKQRFLELWEELHDPSNGYFSSHGIPYHAVETLIVEAPDYGHLTTSEAMSYYLWLEALYGKFTGDFSYFMKAWETIEKYMIPTEQDQPNRSMAGYNPAKPATYAPEWEEPSMYPSQLDFSAPVGIDPIYNELVSTYGTNTIYGMHWLLDVDNWYGFGRRADRISSPAYINTFQRGSQESVWETIPQPCWDDLTIGGRNGFLDLFVGDSQYSAQFKYTNAPDADARAIQATYWANQWAKEHGVNLSQYVKKASRMGDYLRYAMFDKYFRKIGDSKQAGTGYDAAHYLLSWYYAWGGGITADWAWIIGCSHVHAGYQNPMTAWILANDPEFKPESPNGANDWAKSLERQLEFYQWLQSAEGAIAGGATNSYKGRYETLPAGISTFYGMAYEEHPVYLDPGSNTWFGFQAWTMQRVAEYYYLTGDTRAEQLLDKWVDWIKSVVRLNSDGTFEIPGNLEWSGQPDTWTGTYTGNPNLHVSVVSYRTDLGAAGSLANALLYYAKTSGDDEARNLAKELLDRMWNLYRDDKGLSAPETREDYVRFFEQEVYVPQGWSGTMPNGDRIEPGVTFLDIRSKYLNDPDYPKLQQAYNEGKAPVFNYHRFWAQCDIAIANGLYSILFGSEQANDSFITPTSATFDKNNQEDISVTVTYNGNTLLGIKSGSSYLIEGVDYIVNGDVIIIKKEFLAGQATGSISLLFDFSAGLDRTLTIDIIDTGGGEEPVEPVEPVEGVLIIQSFNANTQEISNSIMPRFRIYNSGNTSIPLSEVKLRYYYTVDGDKPQNFWCDWASIGSSNVTGTFVKMDGATTGADYYLEIGFTPQAGTLEPGASIEVQGRFSKIDWTDYTQTNDYSFNPTASSYVDFNKITAYISGNLVYGIEP

SEQ ID NO: 430 - protein, 1711 aa, Anaerocellum thermophilum
GSFNYGEALQKAIMFYEFQMSGKLPNWVRNNWRGDSALKDGQDNGLDLTGGWFDAGDHVKFNLPMSYTGTMLSWAVYEYKDAFVKSGQLEHILNQIEWVNDYFVKCHPSKYVYYYQVGDGSKDHAWWGPAEVMQMERPSFKVTQSSPGSTVVTETAASLAAASIVLKDRNPTKAATYLQHAKELYEFAEVTKSDAGYTAANGYYNSWSGFYDELSWAAVWLYLATNDSTYLTKAESYVQNWPKISGSNTIDYKWAHCWDDVHNGAALLLAKITGKDIYKQIIESHLDYWITGYNGERIKYTPKGLAWLDQWGSLRYATTTAFLAFVYSDWVGCPSTKKEIYRKFGESQIDYALGSAGRSFVVGFGTNPPKRPHHRTAHSSWADSQSIPSYHRHTLYGALVGGPGSDDSYTDDISNYVNNEVACDYNAGFVGALAKMYQLYGGNPIPDFKAIETPTNDEFFVEAGINASGTNFIEIKAIVNNQSGWPAKATDKLKFRYFVDLSELIKAGYSPNQLTLSTNYNQGAKVSGPYVWDASKNIYYILVDFTGTLIYPGGQDKYKKEVQFRIAAPQNVQWDNSNDYSFQDIKGVSSGSVVKTKYIPLYDGDVKVWGDGPGTSGATPTPTATATPTPTPTVTPTPTPTPTSTATPTPTPTPTVTPTPTPTPTATPTSTPTPTSTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTNYGENVKVTAYIDGVLVWGQEPSGATPTPTATPAPTVTPTPTPTPTSTPTATPTATPTPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTNYGENVKVTAYIDGVLVWGQEPSGATPTPTATPAPTVTPTPTPTPTSTPTATPTATPTPTPTPSSTPSVVGEYGQRFMWLWNKIHDPANGYFNQDGIPYHSVETLICERPDYGHLTTSEAFSYYVWLEAVYGKLTGDWSKFKTAWDTLEKYMIPSAEDQPMRSYDPNKPATYAGEWETPDKYPSPLEFNVPVGKDPLHNELVSTYGSTLMYGMHWLMDVDNWYGYGKRGDGVSRASFINTFQRGPEESVWETVPHPSWEEFKWGGPNGFLDLFIKDQNYSKQWRYTDAPDADARAIQATYWAKVWAKEQGKFNEISSYVAKAARMGDYLRYAMFDKYFKPLGCQDKNAAGGTGYDSAHYLLSWYYAWGGALDGAWSWKIGSSHVHFGYQNPMAAWALANDSDMKPKSPNGASDWAKSLKRQIEFYRWLQSAEGAIAGGATNSWNGRYEKYPAGTATFYGMAYEPNPVYHDPGSNTWFGFQAWSMQRVVEYYYVTGDKDAGALLEKWVSWVKSVVKLNSDGTFAIPSTLDWKRQPDTWNGAYTGNSNLHVKVVDYGTDLGITASLANALLYYSAGTKKYGVFDEGAKNLAKELLDRMWKLYRDEKGLSAPEKRADYKRFFEQEVYIPAGWIGKMPNGDVIKSGVKFIDIRSKYKQDPDWPKLEAAYKSGQAPEFRYHRFWAQCDIAIANATYEILFGNQ

SEQ ID NO: 431 - protein, 749 aa, Anaerocellum thermophilum
MRKIILKFCALMMVVILIVSILQILPVFAQSILYEKEKYPHLLGNQVVKKPSVAGRLQIIEKDGKKYLADQKGEIIQLRGMSTHGLQWYGDIINKNAFKALSKDWECNVIRLAMYVGEGGYASNPSIKEKVIEGIKLAIENDMYVIVDWHVLNPGDPNAEIYKGAKDFFKEIATSFPNDYHIIYELCNEPNPNEPGVENSLDGWKKVKAYAQPIIKMLRSLGNQNIIIVGSPNWSQRPDFAIQDPINDKNVMYSVHFYSGTHKVDGYVFENMKNAFENGVPIFVSEWGTSLASGDGGPYLDEADKWLEYLNSNYISWVNWSLSNKNETSAAFVPYINGMHDATPLDPGDDKVWDIEELSISGEYVRARIKGIAYQPIKRDNKIKEGENAPLGEKVLPSTFEDDTRQGWDWDGPSGVKGPITIESANGSKALSFNVEYPEKKPQDGWATAARLILKDINVERGNNKYLAFDFYLKPDRASKGMIQMFLAFSPPSLGYWAQVQDSFNIDLGKTVKCKKDRRTEVYKFNVFFDLDKIQDNKVLSPDTLLRDIIVVIADGNSDFKGKMYIDNVRFTNTLFEDINFENSLYDVIDKLYSKGIIKGISVFKYLPDKNITRAEFAALCVRALNLKIEKYDGRFSDVKSGNWYSDVVYTAYKNKLFEIKENKFFPENILKREEAVALAIEVYKRLTGKIEVNTDDVPIADEKLINPQYRESVKLAIKLGIVDLYSDGTFEPNKSVSRGEVATILYNL

SEQ ID NO: 432 - protein, 688 aa, Anaerocellum thermophilum
MSVCLYKRLKRFSVLILVILFLIVTLIGIETTKTSRVIGETKKSFVEYNFENRFIAPFKASGKSMSLRIDNTTAAEGTFSLLASGRKQIDDGILLDVTNLIDYANEYKITLYVYHKSSKMQRFVVSSEIETKSGKKTKLLCEKIIIPKSWKKLDANLNLTEQKGIKKVWLKVYVPTSTTNFYVDLFTLKVADKSHLIKFENFEDKSIAGFISQDKKCKLSISKEKAYQGTYSIKVQQTVKRQNTTVILPVKGTFEKGKSYSISFYMHQSILKSLNFAVGIRFLESGKNMREIVLGRVTIPKNKWTEVFASYTPSLDSKIKDFVIFIRPLSDISYYYIDNFTISDDGWYSAVPDLDLPSLREKYKNYFKIGVAVPYRALTNPVDVAFIKRHFNSITAENEMKPEALEPIEDNFNFSIADEYLNFCRKNNIAIRGHNLLHQQTPNWFFENPQTGKKLTNSEKDKKILLERLKKYIQTVVSRYKGRIYAWDVVNEAIDENEPDGFRRSDWFNVLGPEYIEKAFIYAHQADPNAQLFYNDYSTENPVKREYIYKLIKSLREKGIPIHGVGLQCHISVSWPSVEEVEKTIKLFSSIPGIKIHVTEIDISVAKEYGEDIDEETKRYLLIQQARKLKDLFDVFKKYKNVVTSVSFWGLKDDYSWLQGDFPLLFDKDYQPKFAFWSLIDPSVVPEE

SEQ ID NO: 433 - protein, 341 aa, Anaerocellum thermophilum
GIYPKPNINYYVNPELEGKNSLEVFDIVVQICKEVGLKIMLDIHSIKTDAMGHIYPVWYGLDKFTPEDFYKACEWITNRYKNDDTIIAFDLKNEPHGKPWQDTTFAKWDNSTDINNWKYAAETCAKRILNINPNLLIVIEGIEAYPKDDVTWTSKSYSDYYSTWWGGNLRGVKKYPINLGKYQNKVVYSPHDYGPSVYQQPWFYPGFTKESLLQDCWRPNWAYIMEENIAPLLIGEWGGYLDGADNEKWMRYLRDYIIENHIHHTFWCFNANSGDTGGMVGYDFTTWDEKKYSFLKPALWQDSQGRFVGLDHKRPLGTNGKNINITIYYNNNEPAPVPAAK

SEQ ID NO: 434 - protein, 1414 aa, Anaerocellum thermophilum
MRVKTKMGKKWLSILCTVVFLLNILFIANVTNLPKVGAATSNDGVVKIDTSTLIGTNHAHCWYRDKLETALRGIRSWGMNSVRVVLSNGYRWTKIPASEVANIISLSRSLGFRAIVLEVHDTTGYGEDGAACSLAQAVEYWKEIKSVLEGNEDFVIINIGNEPYGNNNYQNWINDTKNAIKALRDAGFKHTIMVDAPNWGQDWSNTMRDNAQSIMEADPLRNLVFSIHMYGVYNTASKVEEYIKSFVEKGLPLVIGEFGHQHTDGDPDEEAIVRYAKQYKIGLFSWSWCGNSSYVGYLDMVNNWDPNNPTPWGQWYKTNAIGASSVPTSTPTPTPTATPTATPTPTLTPTPTPTPTPTSTPTATPTATPTPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTSYGENVKVTAYIDGVLVWGQEPSGATPTPTATPAPTPTPTPTPTATPTPTPTPTPTPTATPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTSYGENVKVTAYIDGVLVWGQEPSGATPTPTATPAPTPTPTPTPTATPTPTPTPTPTPTATPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTSYGENVKVTAYIDGVLVWGQEPSGATPTPTATPAPTVTPTATPAPTPTPTPTVTATPTPTPTPVQTVIPMPTVTPNPTSTPSILDDTNDDWLYVSGNKIVDKDGKPVWLTGINWFGYNTGTNVFDGVWSCNLKDTLAEIANRGFNLLRIPISAEIILNWSQGIYPKPNINYYVNPELEGKNSLEVFDIVVQICKEVGLKIMLDIHSIKTDAMGHIYPVWYDDKFTPEDFYKACEWITNRYKNDDTIIAFDLKNEPHGKPWQDTTFAKWDNSTDINNWKYAAETCAKRILNINPNLLIVIEGIEAYPKDDVTWTSKSYSDYYSTWWGGNLRGVKKYPINLGKYQNKVVYSPHDYGPSVYQQPWFYPGFTKESLLQDCWRPNWAYIMEENIAPLLIGEWGGYLDGADNEKWMRYLRDYIIENHIHHTFWCFNANSGDTGGMVGYDFTTWDEKKYSFLKPALWQDSQGRFVGLDHKRPLGTNGKNINITIYYNNNEPAPVPAAK

SEQ ID NO: 435 - protein, 755 aa, Anaerocellum thermophilum
MRKIILKFCALMMVVILIVSILQILPVFAQSILYEKEKYPHLLGNQVVKKPSVAGRLQIIEKDGKKYLADQKGEIIQLRGMSTHGLQWYGDIINKNAFKALSKDWECNVIRLAMYVGEGGYASNPSIKEKVIEGIKLAIENDMYVIVDWHVLNPGDPNAEIYKGAKDFFKEIATSFPNDYHIIYELCNEPNPNEPGVENSLDGWKKVKAYAQPIIKMLRSLGNQNIIIVGSPNWSQRPDFAIQDPINDKNVMYSVHFYSGTHKVDGYVFENMKNAFENGVPIFVSEWGTSLASGDGGPYLDEADKWLEYLNSNYISWVNWSLSNKNETSAAFVPYINGMHDATPLDPGDDKVWDIEELSISGEYVRARIKGIAYQPIKRDNKIKEGENAPLGEKVLPSTFEDDTRQGWDWDGPSGVKGPITIESANGSKALSFNVEYPEKKPQDGWATAARLILKDINVERGNNKYLAFDFYLKPDRASKGMIQIFLAFSPPSLGYWAQVQDSFNIDLAKLSSAKKIEDRIYKFNVFFDLDKIQDNKVLSPDTLLRDIIVVIADGNSDFKGKMYIDNVRFTNILFEDINFENSLYDVIDKLYSKGIIKGISVFKYLPDKNITRAEFAALCVRALNLKIEKYDGRFSDVKSGNWYSDVVYTAYKNKLFEIKENKFFPENILKREEAVALAIEVYKRLTGKIEVNTDDVPIADEKLINPQYRESVKLAIKLGIVDLYSDGTFEPNKSVSRGEVATILYNLLNLAGKL

SEQ ID NO: 436 - protein, 873 aa, Thermobifida fusca
MVSFTSLLAGVAAISGVLAAPAAEVEPVAVEKREAEAEAEPAFNYAEALQKSMFFYEAQRSGKLPENNRVSWRGDSGLNDGADVGLDLTGGWYDAGDHVKFGFPMAFTATMLAWGAIESPEGYIRSGQMPYLKDNLRWVNDYFIKAHPSPNVLYVQVGDGDADHKWWGPAEVMPMERPSFKVDPSCPGSDVAAETAAAMAASSIVFADDDPAYAATLVQHAKQLYTFADTYRGVYSDCVPAGAFYNSWSGYQDELVWGAYWLYKATGDDSYLAKAEYEYDFLSTEQQTDLRSYRWTIAWDDKSYGTYVLLAKETGKQKYIDDANRWLDYWTVGVNGQRVPYSPGGMAVLDTWGALRYAANTAFVALVYAKVIDDPVRKQRYHDFAVRQINYALGDNPRNSSYVVGFGNNPPRNPHHRTAHGSWTDSIASPAENRHVLYGALVGGPGSPNDAYTDDRQDYVANEVATDYNAGFSSALAMLVEEYGGTPLADFPPTEEPDGPEIFVEAQINTPGTTFTEIKAMIRNQSGWPARMLDKGTFRYWFTLDEGVDPADITVSSAYNQCATPEDVHHVSGDLYYVEIDCTGEKIFPGGQSEHRREVQFRIAGGPGWDPSNDWSFQGIGNELAPAPYIVLYDDGVPVWGTAPEEGEEPGGGEGPGGGEEPGEDVTPPSAPGSPAVRDVTSTSAVLTWSASSDTGGSGVAGYDVFLRAGTGQEQKVGSTTRTSFTLTGLEPDTTYIAAVVARDNAGNVSQRSTVSFTTLAENGGGPDASCTVGYSTNDWDSGFTASIRITYHGTAPLSSWELSFTFPAGQQVTHGWNATWRQDGAAVTATPMSWNSSLAPGATVEVGFNGSWSGSNTPPTDFTLNGEPCALA

SEQ ID NO: 437 - DNA, 1482 bp, Saccharomycopsis fibuligera Glucoamylase
atgcaaatttcaaaagctgctttgcttgcctcattggctgcccttgtttatgctcaaccagtgactctattcaaaagagaaactaatgctgataaatggagatcacagtctatttatcaaattgtcactgacagatttgctagaaccgatggtgatacaagtgcttcctgtaacacagaagatagactttactgtggtggttctttccaaggcatcataaagaagttggattacatcaaagatatgggctttactgctatttggatttctccagttgttgaaaacattcccgataacacagcatatggttatgcttatcatggttactggatgaagaacatatacaaaattaatgaaaactttggtactgctgatgatttgaagtctttggcacaagaattgcacgatcgtgatatgttgttaatggtcgatatcgttaccaaccattacggcagtgatggcagtggagatagtatcgattactcagagtacaccccgttcaacgaccaaaagtacttccataactactgtcttatttcaaactatgatgaccaagctcaggttcaaagttgctgggaaggtgactcttcagttgcattaccagatttgagaacggaagatagcgacgtggcctcagttttcaattcttgggttaaagattttgttggcaattactcaattgatggtttaagaattgatagtgctaaacatgtggaccaaggctttttcccggattttgttagtgcatctggagtttactcagtaggcgaagttttccaaggagacccagcttatacatgcccataccaaaattacattccaggggttagtaattatccattgtactacccaaccacgagattttttaaaactactgattcaagttccagtgagttgactcaaatgatttcaagcgttgcttccagttgttcggatccaactttgttgacaaactttgtagaaaatcacgataatgaaaggttcgcttcaatgaccagcgaccaaagtttgatttctaatgctattgcatttgtccttttgggtgatggtattcctgtcatttactatggacaagaacaaggcttgagcggaaaaagtgacccaaacaacagagaggccttgtggttatccggctacaacaaagagagtgactattacaagctcattgccaaagctaatgctgccagaaacgccgccgtttatcaagactcaagctatgccacctcgcagctttctgtgatcttttcaaatgaccatgttattgcaacaaaaagaggcagcgttgtttctgttttcaacaaccttggttccagcggttcttctgatgtgactatttccaacacaggttacagttccggtgaggatttggtagaagttttgacatgcagtactgttagcggcagctctgacttacaagtttctatccaaggtggtcaaccacaaatctttgttcctgctaaatatgcttctgacatttgttca

SEQ ID NO: 438 - DNA, 1521 bp, Debaryomyces occidentalis Alpha amylase
atgaaatttgcaactatcttaagtacaactgctcttgcgctatcaagtttggttgcatccaagccaattttcttaagcaaaagggatgctggcagctctgctgctgcagcttggcgttctgaatctatctatcaacttgttaccgatagatttgccagaactgacggatcgacttcagctacttgtaatactggagatagagtatactgtgggggtactttccaaggtattattgacaaattggattacatccaaggtatgggtttcactgctatttggatttctccagttgttgaacaaattcctgatgatactggttatggttatgcttaccacggctattggatgaaagatatttacgctataaattcaaattttggtactgccgatgacttgaagaatctttcaaatgaattgcataagagaaatatgaagcttatggttgatattgttactaaccattatgcttggaatggtgccggtagcagtgttgcttactccaactacaatccattcaaccaacaatcctacttccacgattattgtttaattacaaattacgatgatcaaaccaatgttgaagattgctgggaaggcgataatactgttagtttaccagatcttcgtactgaggattcagatgttagctctattttcaatctgtgggttgctgagttagtttctaattactcaattgatggtttaaggattgacagtgctaagcatgttgatgaatcattctacccatcattccaaagtgctgcaggtgtctatcttcttggagaagtttatgacggtgatccagcttacacttgcccataccaaaactatatgtcaggggttactaactatcctttgtactatccaatgttaagattctttcaaggtacttctaactctgtcgatgaattaaatgctatgatttcaagtttagaaagtgattgtaaggatattactttattgggtaatttcattgaaaaccatgatcaaccaagattaccatcttatacttctgatagtgccttaatcaaaaatgcaattgcgtttaatttaatgtcagatggtattccaattatttactacggtcaagaacaaggttacagtggtagctccgatccaaacaacagagaagcattatggttatctggttacagcactagtaatggttactacaaacttatctcttcagttaatcaaattagaaaccaagccatttataaggatagcaaatacactacttattggagtgatgtgttatacgcttcaggtcatgttattgctcttcaaagaggtgcagacgaccaaagaattgtttctgtctttaacaatttaggctcaagcggatctcaaactgtaacattcagtactaaatacagcggtggagaaaaagtcgttgacgttttaacttgtcaaacttcatacgccaactcggatagtactttaactgtctctattagtggtggcgctccaagaatttatgctcctgcttctcttattgcaaattctggaatttgcaacttc

SEQ ID NO: 439 - DNA, 1560 bp, Saccharomycopsis fibuligera Glucoamylase
atgagattcggtgttttaatctccgtctttgctgctattgttagtgctttacctttgcaagaaggtcctttgaacaaaagagcctatccttcttttgaagcttattcaaactataaagttgacagaactgacttggaaaccttcttggacaaacaaaaagaagtatctttatactatcttttacaaaacattgcttatcctgaaggccaatttaataatggtgttcctggtactgttattgcttctccatcaacctctaatccggactactattaccaatggaccagagattccgcaattacatttttgacagttctttctgaactagaagataataacttcaataccactttggccaaggcagttgagtactacattaacaccagttacaaccttcaaagaaccagtaacccaagtggcagctttgatgatgaaaatcataaaggcttgggagaaccaaaatttaacacagatggttctgcatacaccggagcttgggggagaccgcaaaatgatggtcctgctttgagagcttatgctatcagtagatacttgaatgatgtcaattctttaaatgaaggtaaattagtattgactgattcaggtggtatcaacttttcttcaactgaagatatttacaaaaatatcatcaaaccagacttggaatatgttatagggtactgggattctactgggtttgatctttgggaggaaaaccaaggcagacacttttttacaagcttggttcaacagaaagcccttgcttatgctgtcgatattgccaaaagttttgacgacggcgactttgcgaacacactttcttcgactgcttctaccctcgaaagttatttgagtggcagtgatggtggatttgttaatactgatgttaaccacattgttgaaaacccagatttgcttcaacaaaactctagacaaggtctagattcagccacatatattggcccacttttgactcatgatattggtgaaagcagctcaactccatttgatgttgacaatgagtatgttttgcaatcatattacttgttattggaggataacaaagacagatactttgttaacagtgcttattctgctggtgcagctattggcagatacccagaagatgtttacaatggtgatggttcatctgaaggcaatccatggttcttagctactgcctatgctgcccaagttccatacaaacttgcttatgatgcaaagtcggcctcaaatgacattaccattaacaagattaactacgatttttttaacaagtatattgttgatttatctaccatcaattctgcttaccagtcttctgatagtgtcaccattaaaagtggctctgatgaatttaacacggttgctgataatttggtcacattcggtgattcctttttgcaagtcattttggatcatattaatgatgatggctccttgaatgaacaacttaacagatataccggttattccaccggtgcctactctttgacatggagcagtggtgctcttcttgaagctattagacttagaaataaggtcaaggctttggcttaa

SEQ ID NO: 440 - DNA, 1545 bp, Saccharomycopsis fibuligera Glucoamylase
atgatcagattgaccgttttcttgaccgctgtttttgctgctgttgcttcttgtgttccagttgaattggataagagaaacaccggtcatttccaagcttattctggttataccgttgctagatctaacttcacccaatggattcatgaacaaccagctgtttcttggtactacttgttgcaaaacatcgattacccagaaggtcaattcaaatctgctaaaccaggtgttgttgttgcttctccatctacatctgaaccagattacttctaccaatggactagagataccgctattaccttcttgtccttgattgctgaagttgaagatcattctttctccaacactaccttggctaaggttgtcgaatattacatttccaacacctacaccttgcaaagagtttctaatccatccggtaacttcgattctccaaatcatgatggtttgggtgaacctaagttcaacgttgatgatactgcttatacagcttcttggggtagaccacaaaatgatggtccagctttgagagcttacgctatttctagatacttgaacgctgttgctaagcacaacaacggtaaattattattggccggtcaaaacggtattccttattcttctgcttccgatatctactggaagattattaagccagacttgcaacatgtttctactcattggtctacctctggttttgatttgtgggaagaaaatcaaggtactcatttcttcaccgctttggttcaattgaaggctttgtcttacggtattccattgtctaagacctacaatgatccaggtttcacttcttggttggaaaaacaaaaggatgccttgaactcctacattaactcttccggtttcgttaactctggtaaaaagcacatcgttgaatctccacaattgtcatctagaggtggtttggattctgctacttatattgctgccttgatcacccatgatatcggtgatgatgatacttacaccccattcaatgttgataactcctacgttttgaactccttgtattacctattggtcgacaacaagaacagatacaagatcaacggtaactacaaagctggtgctgctgttggtagatatcctgaagatgtttacaacggtgttggtacttctgaaggtaatccatggcaattggctactgcttatgctggtcaaactttttacaccttggcctacaattccttgaagaacaagaagaacttggtcatcgaaaagttgaactacgacttgtacaactccttcattgctgatttgtccaagattgattcttcctacgcttctaaggattctttgactttgacctacggttccgataactacaagaacgttatcaagtccttgttgcaattcggtgactcattcttgaaggttttgttggatcacatcgatgacaacggtcaattgactgaagaaatcaacagatacaccggttttcaagctggtgcagtttctttgacttggtcatctggttctttgttgtctgctaatagagccagaaacaagttgatcgaattattg

SEQ ID NO: 441 - DNA, 2889 bp, Saccharomycopsis fibuligera Glucoamylase
atgatctggttgaagttgtccttgtactctttggcttttgctttgtttgctgatgctgctccagtttcttctggtgaagaagctgaaacttctagctctacttcttcatctgctccagctcaaattaccgttgataacgaattgaccttgggtgtttctcaagttccaaacatcgttaacaagaccgctattgatgctaatgaagctgctaaaggttacgatttggttaacgttactactactgctaagggtttgaccggtattttgaagttgaatgaagccactaacatctacggttacgatttcgattacttgaacttgtccgtcgaataccaatccgatgatagattgaacgttcacatcgaaccagttgataccgataacgttttcattttgccagaatccttggttgctaaaccatctgctgatgatggtgataagatcgaatcttttcatttcggtggttcctccgatttggtttttgaatactcttccaagaacttcggtttcgaaatcttgagaaagtctaccggtaagtctattttctccactattggtaacccattggttttctccaatcaattcatccaattcaacacatccttgccaaaggatcatttcattactggtttgggtgaatccatccatggttttagaaatgaaccaggtatcgtcaaaaccttgtacgctaatgatattgccaacccaatcgatggtaatatctatggtgttcacccattctacatcgatcaaagatttgataccaacgctacccatggtgtttattggagaacttctgccattcaagaagttgctgttggtaacgaatccttgacttggagagctttgtctggtatagttgacttgtactttttctccggtccaaaacctaaggatgtcattcaacaatacgtcaaagaagttggtttgccaacttttcaaccatattgggctttgggttaccatcaatgtagatggggttacgataccatcgaagaattggatgaagtcgtcgaaaacttcaagaacttcgatattccattggaaaccatctggtccgatatcgattacatggattcctacaaggatttcaccaacgatccacatagatacccattggaaaagtaccaacaattcttggacaagttgcacgaaaacaatcaacactacgttccaattattgatgccgctatctacgttccaaatccagaaaatgctaccgataacgattacgatgttttccattacggtaacgaaaccgacgtttttttgaagaatccagatggttccttgtacattggtgctgtttggccaggttatactgtttttccagatttcttgtccgaaaacatccaaaagtactggaccaaggttttcaaggactggtatcaacaaatcaagttcgatggtatctggttggatatgaacgaagtttcttctttctgtgttggttcttgtggttctggtaagattactgataacccagttcatccaccatttgctgttggtggtgaagctactgaatttccagaaggtttcaacaagaccaacggtactgaatacgcttctttcacttcttctttggctgctgcttctccaacttctgatgaagattcttctgcttcttctacctctgcttctattgattctttgaacactttggctccaggtaagggtaatattaactatccaccatacgccatcaacaacgatcaaggtgatcatgatttggctactcatgctgtttctccaaatgctactcatcaagatggtactttggaatacgatgtccataacttgtacggttacttggaaactaacgctactttcgaagccttgttggaaatccaacctaacaaaagaccattcatcatctccagatcttcatttgctggttctggtagacaaactggtcattggggtggtgataattactctcaattcagatctgcctacttctctattgctcaagctttttctttcggtttgtccggtattccattttttggtgctgatgtttgtggtttcaacggtaattccgattacgaattgtgttccagatggatgcaattgggttcatttttcccattctacagaaaccacaacattttgggtgccatttctcaagaaccatacgtttgggaatctgttactgaagctactaagacctccatgcaaatcagatatttgttgttgccttactactacaccttgttgcatgaagctcatattaccggtatcccaattttgagagcttttgcttggcaattcccagaaaacaagaacgtttctaccgttgatacccaattctttgttggtgatgctttggttgttactccagctttggaacaaggtgttgatactgttaagggtacttttccaggttctggtaacgaagaagtttactacgattggtacacccacgaaaagcaaaatttcactgacggtaagaacgaaacattgcaagctccattgggtcatattccattgcatattagaggtggtcatatcttgccaactcaagaaccagcttacactactactgaatctagacaaaatccatggggtttgatagttgccttggataaggatggtaaagccgaaggtaaattatactccgatgatggtgaatcctacgaagttgaagaatccttgttcgttaacttcattgcttccgataataccttgttgtctacctcttacggtgaatatgaagtcgaacaaccattggccaacattactattttgggtgttgaaaacaagccaaaagaagttaagttcgacgattccaaggttgatttcaccttcgaaaacaacaccattttcgttaccggtttggatgatcaaactgaagatggtgcttttgctaagcactttaagttgtcttgg

SEQ ID NO: 442 - protein, 494 aa, Saccharomycopsis fibuligera Glucoamylase
MQISKAALLASLAALVYAQPVTLFKRETNADKWRSQSIYQIVTDRFARTDGDTSASCNTEDRLYCGGSFQGIIKKLDYIKDMGFTAIWISPVVENIPDNTAYGYAYHGYWMKNIYKINENFGTADDLKSLAQELHDRDMLLMVDIVTNHYGSDGSGDSIDYSEYTPFNDQKYFHNYCLISNYDDQAQVQSCWEGDSSVALPDLRTEDSDVASVFNSWVKDFVGNYSIDGLRIDSAKHVDQGFFPDFVSASGVYSVGEVFQGDPAYTCPYQNYIPGVSNYPLYYPTTRFFKTTDSSSSELTQMISSVASSCSDPTLLTNFVENHDNERFASMTSDQSLISNAIAFVLLGDGIPVIYYGQEQGLSGKSDPNNREALWLSGYNKESDYYKLIAKANAARNAAVYQDSSYATSQLSVIFSNDHVIATKRGSVVSVFNNLGSSGSSDVTISNTGYSSGEDLVEVLTCSTVSGSSDLQVSIQGGQPQIFVPAKYASDICS

SEQ ID NO: 443 - protein, 507 aa, Debaryomyces occidentalis Alpha amylase
MKFATILSTTALALSSLVASKPIFLSKRDAGSSAAAAWRSESIYQLVTDRFARTDGSTSATCNTGDRVYCGGTFQGIIDKLDYIQGMGFTAIWISPVVEQIPDDTGYGYAYHGYWMKDIYAINSNFGTADDLKNLSNELHKRNMKLMVDIVTNHYAWNGAGSSVAYSNYNPFNQQSYFHDYCLITNYDDQTNVEDCWEGDNTVSLPDLRTEDSDVSSIFNLWVAELVSNYSIDGLRIDSAKHVDESFYPSFQSAAGVYLLGEVYDGDPAYTCPYQNYMSGVTNYPLYYPMLRFFQGTSNSVDELNAMISSLESDCKDITLLGNFIENHDQPRLPSYTSDSALIKNAIAFNLMSDGIPIIYYGQEQGYSGSSDPNNREALWLSGYSTSNGYYKLISSVNQIRNQAIYKDSKYTTYWSDVLYASGHVIALQRGADDQRIVSVFNNLGSSGSQTVTFSTKYSGGEKVVDVLTCQTSYANSDSTLTVSISGGAPRIYAPASLIANSGICNF

SEQ ID NO: 444 - protein, 519 aa, Saccharomycopsis fibuligera Glucoamylase
MRFGVLISVFAAIVSALPLQEGPLNKRAYPSFEAYSNYKVDRTDLETFLDKQKEVSLYYLLQNIAYPEGQFNNGVPGTVIASPSTSNPDYYYQWTRDSAITFLTVLSELEDNNFNTTLAKAVEYYINTSYNLQRTSNPSGSFDDENHKGLGEPKFNTDGSAYTGAWGRPQNDGPALRAYAISRYLNDVNSLNEGKLVLTDSGGINFSSTEDIYKNIIKPDLEYVIGYWDSTGFDLWEENQGRHFFTSLVQQKALAYAVDIAKSFDDGDFANTLSSTASTLESYLSGSDGGFVNTDVNHIVENPDLLQQNSRQGLDSATYIGPLLTHDIGESSSTPFDVDNEYVLQSYYLLLEDNKDRYFVNSAYSAGAAIGRYPEDVYNGDGSSEGNPWFLATAYAAQVPYKLAYDAKSASNDITINKINYDFFNKYIVDLSTINSAYQSSDSVTIKSGSDEFNTVADNLVTFGDSFLQVILDHINDDGSLNEQLNRYTGYSTGAYSLTWSSGALLEAIRLRNKVKALA

SEQ ID NO: 445 - protein, 515 aa, Saccharomycopsis fibuligera Glucoamylase
MIRLTVFLTAVFAAVASCVPVELDKRNTGHFQAYSGYTVARSNFTQWIHEQPAVSWYYLLQNIDYPEGQFKSAKPGVVVASPSTSEPDYFYQWTRDTAITFLSLIAEVEDHSFSNTTLAKVVEYYISNTYTLQRVSNPSGNFDSPNHDGLGEPKFNVDDTAYTASWGRPQNDGPALRAYAISRYLNAVAKHNNGKLLLAGQNGIPYSSASDIYWKIIKPDLQHVSTHWSTSGFDLWEENQGTHFFTALVQLKALSYGIPLSKTYNDPGFTSWLEKQKDALNSYINSSGFVNSGKKHIVESPQLSSRGGLDSATYIAALITHDIGDDDTYTPFNVDNSYVLNSLYYLLVDNKNRYKINGNYKAGAAVGRYPEDVYNGVGTSEGNPWQLATAYAGQTFYTLAYNSLKNKKNLVIEKLNYDLYNSFIADLSKIDSSYASKDSLTLTYGSDNYKNVIKSLLQFGDSFLKVLLDHIDDNGQLTEEINRYTGFQAGAVSLTWSSGSLLSANRARNKLIELL

SEQ ID NO: 446 - protein, 963 aa, Saccharomycopsis fibuligera Glucoamylase
MIWLKLSLYSLAFALFADAAPVSSGEEAETSSSTSSSAPAQITVDNELTLGVSQVPNIVNKTAIDANEAAKGYDLVNVTTTAKGLTGILKLNEATNIYGYDFDYLNLSVEYQSDDRLNVHIEPVDTDNVFILPESLVAKPSADDGDKIESFHFGGSSDLVFEYSSKNFGFEILRKSTGKSIFSTIGNPLVFSNQFIQFNTSLPKDHFITGLGESIHGFRNEPGIVKTLYANDIANPIDGNIYGVHPFYIDQRFDTNATHGVYWRTSAIQEVAVGNESLTWRALSGIVDLYFFSGPKPKDVIQQYVKEVGLPTFQPYWALGYHQCRWGYDTIEELDEVVENFKNFDIPLETIWSDIDYMDSYKDFTNDPHRYPLEKYQQFLDKLHENNQHYVPIIDAAIYVPNPENATDNDYDVFHYGNETDVFLKNPDGSLYIGAVWPGYTVFPDFLSENIQKYWTKVFKDWYQQIKFDGIWLDMNEVSSFCVGSCGSGKITDNPVHPPFAVGGEATEFPEGFNKTNGTEYASFTSSLAAASPTSDEDSSASSTSASIDSLNTLAPGKGNINYPPYAINNDQGDHDLATHAVSPNATHQDGTLEYDVHNLYGYLETNATFEALLEIQPNKRPFIISRSSFAGSGRQTGHWGGDNYSQFRSAYFSIAQAFSFGLSGIPFFGADVCGFNGNSDYELCSRWMQLGSFFPFYRNHNILGAISQEPYVWESVTEATKTSMQIRYLLLPYYYTLLHEAHITGIPILRAFAWQFPENKNVSTVDTQFFVGDALVVTPALEQGVDTVKGTFPGSGNEEVYYDWYTHEKQNFTDGKNETLQAPLGHIPLHIRGGHILPTQEPAYTTTESRQNPWGLIVALDKDGKAEGKLYSDDGESYEVEESLFVNFIASDNTLLSTSYGEYEVEQPLANITILGVENKPKEVKFDDSKVDFTFENNTIFVTGLDDQTEDGAFAKHFKLSW

SEQ ID NO: 447 - protein, 252 aa, Bifidobacterioum adolescentis pflA
MDGNIHSIETFGTVDGPGIRYVVFTQGCLMRCQFCHNADTWEIGTGKQMTVSEIVQDVQHYLPFIQSSGGGITVSGGEPLLQLPFLIELFKACKSLGIHTALDSSGGCYSAAPAFQEQIKELIQYTDLVLLDLKHHNRKKHINLTGMPNDHILEFARFLAEHQVPVWIRHVLVPGISDIDADLTALGTFIGTLANVQKVEVLPYHKLGVYKWEALGLDYPLKGVEPPSADRAENAYRLLTAHLQGGSLLQET

SEQ ID NO: 448 - protein, 741 aa, Bifidobacterioum adolescentis pflB
MEQWKGFTTNVWQKEVNVRDFILSNFEPYQGDESFLEPPTEATSALWDHVMDLTKKERENGGVLDMDTEIVSTITSHGPGYLNKDLEKVVGVQTDEPFKRSLQPFGGIRMAKQACESYGFKLNEEVERIFTDYRKTHNQGVFDAYTDEMKLARKVGIITGLPDAYGRGRIIGDYRRVALYGVDFLIDEKKKDAAGTSRVMSEENIRLREELSEQIRALNELKALAKSYGFDISKPAANAREAFQWLYFAYLAAIKEQNGAAMSLGRVSTFLDIYIERDLKTGVLTEREAQELVDHFVMKLRLVKFARTPDYNELFSGDPTWVTESIGGMAHDGRALVTKNSFRFLHTLDNLGPAPEPNLTVLWSVRLPQKFKNYCAKMSIKTSSIQYENDDIMRPEYGDDYGIACCVSAMAIGKQMQFFGARANLAKALLYAINGGKDEKHKMQVGPEMPPVASDVLDYDEVMHKFDQTMEWLAGLYINTLNVIHYMHDKYCYERIEMALHDTEILRTMATGIAGLSVVADSLSAVKYAKVSVVRDENGIAVDFETEGDFPKYGNNDDRVDAIAVDIVKRFMKKLRKHQTYRQSVQTMSILTITSNVVYGKKTGNTPDGRRAGEPFAPGANPMHGRDTKGTLASLSSVAKLPYSYALDGISNTFSIVPKALGKDEESRAANLSSILDGYAAKTGHHLNVNVFNRETLLDAMEHPEEYPQLTIRVSGYAVNFIKLTKEQQLDVISRTFHESM

SEQ ID NO: 449 - protein, 910 aa, Bifidobacterioum adolescentis AdhE
MADAKKKEEPTKPTPEEKLAAAEAEVDALVKKGLKALDEFEKLDQKQVDHIVAKASVAALNKHLVLAKMAVEETHRGLVEDKATKNIFACEHVTNYLAGQKTVGIIREDDVLGIDEIAEPVGVVAGVTPVTNPTSTAIFKSLIALKTRCPIIFGFHPGAQNCSVAAAKIVRDAAIAAGAPENCIQWIEHPSIEATGALMKHDGVATILATGGPGMVKAAYSSGKPALGVGAGNAPAYVDKNVDVVRAANDLILSKHFDYGMICATEQAIIADKDIYAPLVKELKRRKAYFVNADEKAKLEQYMFGCTAYSGQTPKLNSVVPGKSPQYIAKAAGFEIPEDATILAAECKEVGENEPLTMEKLAPVQAVLKSDNKEQAFEMCEAMLKHGAGHTAAIHTNDRDLVREYGQRMHACRIIWNSPSSLGGVGDIYNAIAPSLTLGCGSYGGNSVSGNVQAVNLINIKRIARRNNNMQWFKIPAKTYFEPNAIKYLRDMYGIEKAVIVCDKVMEQLGIVDKIIDQLRARSNRVTFRIIDYVEPEPSVETVERGAAMMREEFEPDTIIAVGGGSPMDASKIMWLLYEHPEISFSDVREKFFDIRKRAFKIPPLGKKAKLVCIPTSSGTGSEVTPFAVITDHKTGYKYPITDYALTPSVAIVDPVLARTQPRKLASDAGFDALTHAFEAYVSVYANDFTDGMALHAAKLVWDNLAESVNGEPGEEKTRAQEKMHNAATMAGMAFGSAFLGMCHGMAHTIGALCHVAHGRTNSILLPYVIRYNGSVPEEPTSWPKYNKYIAPERYQEIAKNLGVNPGKTPEEGVENLAKAVEDYRDNKLGMNKSFQECGVDEDYYWSIIDQIGMRAYEDQCAPANPRIPQIEDMKDIAIAAYYGVSQAEGHKLRVQRQGEAATEEASERA

SEQ ID NO: 450 - protein, 327 aa, Aspergillus niger xynA xylanase [sequence omitted]

SEQ ID NO: 451 - protein, 860 aa, Aspergillus niger Bgl1 beta-glucosidase
MRFTLIEAVALTAVSLASADELAYSPPYYPSPWANGQGDWAQAYQRAVDIVSQMTLDEKVNLTTGTGWELELCVGQTGGVPRLGVPGMCLQDSPLGVRDSDYNSAFPAGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGFGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGYKYYYVSEGPYEKVNQYVNVQRNHSELIRRIGADSTVLLKNDGALPLTGKERLVALIGEDAGSNPYGANGCSDRGCDNGTLAMGWGSGTANFPYLVTPEQAISNEVLKHKNGVFTATDNWAIDQIEALAKTASVSLVFVNADSGEGYINVDGNLGDRRNLTLWRNGDNVIKAAASNCNNTIVVIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTFNYSNLEVQVLSAPAYEPASGETEAAPTFGEVGNASDYLYPSGLQRITKFIYPWLNGTDLEASSGDASYGQDSSDYLPEGATDGSAQPILPAGGGPGGNPRLYDELIRVSVTIKNTGKVAGDEVPQLYVSLGGPNEPKIVLRQFERITLQPSEETKWSTTLTRRDLANWNVEKQDWEITSYPKMVFVGSSSRKLPLRASLPTVH

SEQ ID NO: 452 - protein, 958 aa, Debaryomyces occidentalis gam1 alpha-glucosidase glucoamylase
MIFLKLIKSIVIGLGLVSAIQAAPASSIGSSASASSSSESSQATIPNDVTLGVKQIPNIFNDSAVDANAAAKGYDLVNVTNTPRGLTGILKLKEATNIYGYDFDYLNLTVEYQADTRLNVHIEPTDLSDVFVLPEHLVVKPLVEGDAQSYNFDNSDLVFEYSNTDFSFEVIRSSTKEVLFSTKGNPLVFSNQFIQFNSSLPKNHVITGLGESIHGLVNEPGSVKTLFANDVGDPIDGNIYGVHPVYLDQRYDTETTHAVYWRTSAIQEVLIGEESITWRALSGVIDLYFFSGPTPKDAIQQYVKEIGLPAFQPYWSLGYHQCRWGYDTIEKLSEVVENFKKFNIPLETIWSDIDYMDSYKDFTYDPHRFPLDEYRKFLDELHKNNQHYVPILDAAIYVPNPNNATDNEYQPFHYGNETDVFLKNPDGSLYIGAVWQVTLFSRFLSRKHSDMDKVIKDWYELTPFDGIWADMNEVSSFCVGSCGTGKYFENPAYPPFTVGSKATSYPVGFDVSNASEWKSIQSSISATAKTSSTSSVSSSSSTIDYMNTLAPGKGNINYPPYAIYNMQGDSDLATHAVSPNATHADGTVEYDIHNLYGYLQENATYHALLEVFPNKRPFMISRSTFPRAGKWTGHWGGDNTADWAYAYFSIPQAFSMGIAGLPFFGADVCGFNGNSDSELCSRWMQLGSFFPFYRNHNYLGAIDQEPYVWESVAEATRTSMAIRYLLLPYYYTLLHESHTTGLPILRAFSWQFPNDRSLSGVDNQFFVGDGLVVTPVLEPGVDKVKGVFPGAGKEEVYYDWYTQREVHFKDGKNETLDAPLGHIPLHIRGGNVLPTQEPGYTVAESRQNPFGLIVALDNDGKAQGSLYLDDGESLVVDSSLLVSFSVSDNTLSASPSGDYKADQPLANVTILGVGHKPKSVKFENANVDFTYKKSTVFVTGLDKYTKDGAFSKDFTITW

SEQ ID NO: 453 - protein, 437 aa, Piromyces sp. XI xylose isomerase
MAKEYFPQIQKIKFEGKDSKNPLAFHYYDAEKEVMGKKMKDWLRFAMAWWHTLCAEGADQFGGGTKSFPWNEGTDAIEIAKQKVDAGFEIMQKLGIPYYCFHDVDLVSEGNSIEEYESNLKAVVAYLKEKQKETGIKLLWSTANVFGHKRYMNGASTNPDFDVVARAIVQIKNAIDAGIELGAENYVFWGGREGYMSLLNTDQKREKEHMATMLTMARDYARSKGFKGTFLIEPKPMEPTKHQYDVDTETAIGFLKAHNLDKDFKVNIEVNHATLAGHTFEHELACAVDAGMLGSIDANRGDYQNGWDTDQFPIDQYELVQAWMEIIRGGGFVTGGTNFDAKTRRNSTDLEDIIIAHVSGMDAMARALENAAKLLQESPYTKMKKERYASFDSGIGKDFEDGKLTLEQVYEYGKKNGEPKQTSGKQELYEAIVAMYQ

SEQ ID NO: 454 - protein, 438 aa, Bacteroides Thetaiotaomicron XI xylose isomerase
MATKEFFPGIEKIKFEGKDSKNPMAFRYYDAEKVINGKKMKDWLRFAMAWWHTLCAEGGDQFGGGTKQFPWNGNADAIQAAKDKMDAGFEFMQKMGIEYYCFHDVDLVSEGASVEEYEANLKEIVAYAKQKQAETGIKLLWGTANVFGHARYMNGAATNPDFDVVARAAVQIKNAIDATIELGGENYVFWGGREGYMSLLNTDQKREKEHLAQMLTIARDYARARGFKGTFLIEPKPMEPTKHQYDVDTETVIGFLKAHGLDKDFKVNIEVNHATLAGHTFEHELAVAVDNGMLGSIDANRGDYQNGWDTDQFPIDNYELTQAMMQIIRNGGLGTGGTNFDAKTRRNSTDLEDIFIAHIAGMDAMARALESAAALLDESPYKKMLADRYASFDGGKGKEFEDGKLTLEDVVAYAKTKGEPKQTSGKQELYEAILNMYC

SEQ ID NO: 455 - protein, 442 aa, Chitinophaga pinensis XI xylose isomerase
MSITLGNQEYFKGIGKIAYEGPQSTNPFAYKWYDENRKIGGKTMKELFRFAVSYWHTFCGTGGDPFGPGTKAFPWLTATDAVQSAKDKMDAAFEFFTKLGVPYYCFHDVDLVDEGASISEYESRMQQIVEYAKEKQKASGVKLLWGTANVFSNPRYMNGAATNPDFAAVAYAGTQVKNSLDATIALGGENYVFWGGREGYMTLLNTDMKREQEHLARFLTMAKDYARKQGFTGTFFIEPKPCEPTKHQYDYDAATVIGFLRHFGLDKDFKLNLEVNHATLAGHTFQHELQVAADAGMLGSIDANRGDAQNGWDTDQFPMNLNDMVEFMLVILEAGGFSGGGVNFDAKTRRNSTDLEDIFHAHIGGIDSFARAAVIAEKVLEQSPYKQFRKDRYASFDSGKGKDFEAGTLTLEDLRSFAVSNGEPKHISGKQEWLENIINQYI

SEQ ID NO: 456 - protein, 442 aa, Parabacteroides distasonis XI xylose isomerase
MSYFKGEKEFFPGIGQIQFEGRESKNPLAFHYYDADKVVMGKTLKDHLRFAMAYWHTLCAEGGDQFGGGTKTFPWNDSTDAITRAKYKMDAAFEFMTKCNIPYYCFHDVDVVDEAPTLGEFEKRLQTMVEHAKEHQAATGKKLLWSTANVFGHKRYMNGAATNPYFPTVACVGTQIKNAIDACIALGGENYVFWGGREGYMSLLNTNMKREKDHLAMMLTMARDYGRKNGFKGTFLIEPKPMEPTKHQYDVDSETVIGFLRHYGLDKDFALNIEVNHATLAGHTFEHELQAAADAGMLCSIDANRGDYQNGWDTDQFPMDIYELAQAWLVILEGGGLTTGGTNFDAKTRRNSTDLEDIFIAHIGGMDAFARALMIAADILENSDYRKMRAERYASFDAGEGKAFEDGKLTLEDLRTIALRDGEPKQISGKQELYEMIVNLHI

SEQ ID NO: 457 - protein, 600 aa, Saccharomyces cerevisiae XK xylulokinase
MLCSVIQRQTREVSNTMSLDSYYLGFDLSTQQLKCLAINQDLKIVHSETVEFEKDLPHYHTKKGVYIHGDTIECPVAMWLEALDLVLSKYREAKFPLNKVMAVSGSCQQHGSVYWSSQAESLLEQLNKKPEKDLLHYVSSVAFARQTAPNWQDHSTAKQCQEFEECIGGPEKMAQLTGSRAHFRFTGPQILKIAQLEPEAYEKTKTISLVSNFLTSILVGHLVELEEADACGMNLYDIRERKFSDELLHLIDSSSKDKTIRQKLMRAPMKNLIAGTICKYFIEKYGFNTNCKVSPMTGDNLATICSLPLRKNDVLVSLGTSTTVLLVTDKYHPSPNYHLFIHPTLPNHYMGMICYCNGSLARERIRDELNKERENNYEKTNDWTLFNQAVLDDSESSENELGVYFPLGEIVPSVKAINKRVIFNPKTGMIEREVAKFKDKRHDAKNIVESQALSCRVRISPLLSDSNASSQQRLNEDTIVKFDYDESPLRDYLNKRPERTFFVGGASKNDAIVKKFAQVIGATKGNFRLETPNSCALGGCYKAMWSLLYDSNKIAVPFDKFLNDNFPWHVMESISDVDNENWDRYNSKIVPLSELEKTLI

SEQ ID NO: 458 - protein, 238 aa, Saccharomyces cerevisiae rpe ribulose-phosphate 3-epimerase
MVKPIIAPSILASDFANLGCECHKVINAGADWLHIDVMDGHFVPNITLGQPIVTSLRRSVPRPGDASNTEKKPTAFFDCHMMVENPEKWVDDFAKCGADQFTFHYEATQDPLHLVKLIKSKGIKAACAIKPGTSVDVLFELAPHLDMALVMTVEPGFGGQKFMEDMMPKVETLRAKFPHLNIQVDGGLGKETIPKAAKAGANVIVAGTSVFTAADPHDVISFMKEEVSKELRSRDLLD

SEQ ID NO: 459 - protein, 258 aa, Saccharomyces cerevisiae rpi ribose 5-phosphate isomerase
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEK

SEQ ID NO: 460 - protein, 680 aa, Saccharomyces cerevisiae tkl transketolase
MTQFTDIDKLAVSTIRILAVDTVSKANSGHPGAPLGMAPAAHVLWSQMRMNPTNPDWINRDRFVLSNGHAVALLYSMLHLTGYDLSIEDLKQFRQLGSRTPGHPEFELPGVEVTTGPLGQGISNAVGMAMAQANLAATYNKPGFTLSDNYTYVFLGDGCLQEGISSEASSLAGHLKLGNLIAIYDDNKITIDGATSISFDEDVAKRYEAYGWEVLYVENGNEDLAGIAKAIAQAKLSKDKPTLIKMTTTIGYGSLHAGSHSVHGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLTPSNLTRWKEALDFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSRQNLPQLEGSSIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGASGKAPEVFKFFGFTPEGVAERAQKTIAFYKGDKLISPLKKAF

SEQ ID NO: 461 - protein, 335 aa, Saccharomyces cerevisiae tal transaldolase
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKIYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 462 - protein, 509 aa, Bacteroides thetaiotamicron araA arabinose isomerase
MNNVFDQYEVWFVTGAQLLYGGDAVIAVDAHSNEMVNGLNESGKLPVKVVYKGTANSSKEVEAVFKAANNDDKCVGVITWMHTFSPAKMWIHGLQQLKKPLLHLHTQFNKEIPWDTMDMDFMNLNQSAHGDREFGHICTRMRIRRKVVVGYWKEEETLHKIAVWMRVCAGWADSQDMLIIRFGDQMNNVAVTDGDKVEAEQRMGYHVDYCPASELMEYHKDIKNADVDALVATYFNDYDHDASLEDKSTEAYQKVWNAAKAELALRAILKAKGAKGFTTNFDDLGQTDGSYFDQIPGLASQRLMAEGYGFGAEGDWKSAALYRTVWVMNQGLPKGCSFLEDYTLNFDGANSSILQSHMLEICPLIAANKPRLEVHFLGIGIRKSQTARLVFTSKTGTGCTATVVDMGNRFRLIVNDVECIEPKPLPKLPVASALWIPMPNLEVGAGAWILAGGTHHSCFSYDLTAEYWEDYAEIAGIEMVHINKDTTISCFKKELRMNEVYYMLNKALC

SEQ ID NO: 463 - protein, 551 aa, Kluyveromyces lactis AI arabinose isomerase
MSLKNWLLLRDIQYEGTFYKKFPHVYNIYVIGFIACISGLMFGFDIASMSSMIGTDVYKDYFSNPDSLTYGGITASMAGGSFLGSLISPNFSDAFGRKVSLHICAALWIIGAILQCAAQDQAMLIVGRVISGMGIGFGSSAAPVYCSEISPPKIRGTISGLFQFSVTVGIMVLFYIGYGCHFIDGAAAFRITWGLQMVPGLILMVGVFFIPESPRWLANHDRWEETSLIVANIVANGDVNNEQVRFQLEEIKEQVIIDSAAKNFGYKDLFRKKTLPKTIVGVSAQMWQQLCGMNVMMYYIVYIFNMAGYTGNTNLVASSIQYVLNVVMTIPALFLIDKFGRRPVLIIGGIFMFTWLFSVAGILATYSVPAPGGVNGDDTVTIQIPSENTSAANGVIASSYLFVCFFAPTWGIGIWIYCSEIFNNMERAKGSALSAATNWAFNFALAMFVPSAFKNISWKTYIIFGVFSVALTIQTFFMFPETKGKTLEEIDQMWVDNIPAWRTANYIPQLPIVKDEEGNKLGLLGNPQHLEDVHSNEKGLLDRSDSASNSN

SEQ ID NO: 464 - protein, 227 aa, Bacteroides thetaiotamicron araB ribulokinase
MLEELKEKVFHANLELVKHGLVIFTWGNVSAIDRETELVVIKPSGVSYDDMKAEDMVVVDLDGKVVEGRLKPSSDTPTHVVLYKAFPEIGGVVHTHSTYATAWAQAGCDIPNIGTTHADYFHDAIPCTADMTEAEVKGAYELETGNVIVKRFEGLNPVHTPGVLVKNHGPFSWGKDAHDAVHNAVVMEQVAKMASIAYAVNPNLTMNPLLVEKHFSRKHGPNAYYGQ

SEQ ID NO: 465 - protein, 227 aa, Bacteroides thetaiotamicron araD ribulose-5-phosphate 4-epimerase; identical to SEQ ID NO: 464

SEQ ID NO: 466 - protein, 482 aa, Chrysosporium lucknowense CBH2b cellobiohydrolase
MAKKLFITAALAAAVLAAPVIEERQNCGAVWTQCGGNGWQGPTCCASGSTCVAQNEWYSQCLPNSQVTSSTTPSSTSTSQRSTSTSSSTTRSGSSSSSSTTPPPVSSPVTSIPGGATSTASYSGNPFSGVRLFANDYYRSEVHNLAIPSMTGTLAAKASAVAEVPSFQWLDRNVTIDTLMVQTLSQVRALNKAGANPPYAAQLVVYDLPDRDCAAAASNGEFSIANGGAANYRSYIDAIRKHIIEYSDIRIILVIEPDSMANMVTNMNVAKCSNAASTYHELTVYALKQLNLPNVAMYLDAGHAGWLGWPANIQPAAELFAGIYNDAGKPAAVRGLATNVANYNAWSIASAPSYTSPNPNYDEKHYIEAFSPLLNSAGFPARFIVDTGRNGKQPTGQQQWGDWCNVKGTGFGVRPTANTGHELVDAFVWVKPGGESDGTSDTSAARYDYHCGLSDALQPAPEAGQWFQAYFEQLLTNANPPF

SEQ ID NO: 467 - protein, 527 aa, Talaromyces emersonii cbh1 and CBD cellobiohydrolase
MLLQAFLFLLAGFAAKISAQQAGTATAENHPPLTWQECTAPGSCTTQNGAVVLDANWRWVHDVNGYTNCYTGNTWDPTYCPDDETCAQNCALDGADYEGTYGVTSSGSSLKLNFVTGSNVGSRLYLLQDDSTYQIFKLLNREFSFDVDVSNLPCGLNGALYFVAMDADGGVSKYPNNKAGAKYGTGYCDSQCPRDLKFIDGEANVEGWQPSSNNANTGIGDHGSCCAEMDVWEANSISNAVTPHPCDTPGQTMCSGDDCGGTYSNDRYAGTCDPDGCDFNPYRMGNTSFYGPGKIIDTTKPFTVVTQFLTDDGTDTGTLSEIKRFYIQNSNVIPQPNSDISGVTGNSITTEFCTAQKQAFGDTDDFSQHGGLAKMGAAMQQGMVLVMSLWDDYAAQMLWLDSDYPTDADPTTPGIARGTCPTDSGVPSDVESQSPNSYVTYSNIKFGPINSTFTASLPGAGNGGNNGGNPPPPTTTTSSAPATTTTASAGPKAGRWQQCGGIGFTGPTQCEEPYICTKLNDWYSQCL

SEQ ID NO: 468 - protein, 894 aa, Saccharomycopsis fibuligera BGL beta-glucosidase
MVSFTSLLAGVAAISGVLAAPAAEVESVAVEKRSRVPIQNYTQSPSQRDESSQWVSPHYYPTPQGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYYADNTTEIVKVNYNVDPSNDFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEYEVSNAKVSAAKKVDEELPEPATYLSEFSYQNAKDSKNPSDAFAPADLNRVNEYLYPYLDSNVTLKDGNYEYPDGYSTEQRTTPNQPGGGLGGNDALWEVAYNSTDKFVPQGNSTDKFVPQLYLKHPEDGKFETPIQLRGFEKVELSPGEKKTVDLRLLRRDLSVWDTTRQSWIVESGTYEALIGVAVNDIKTSVLFTI

SEQ ID NO: 469 - protein, 891 aa, Escherichia coli AADH
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 470 - protein, 872 aa, Clostridium phytofermentans AADH
MTKKVELQTTGLVDSLEALTAKFRELKEAQELFATYTQEQVDKIFFAAAMAANQQRIPLAKMAVEETGMGIVEDKVIKNHYAAEYIYNAYKDTKTCGVVEEDPSFGIKKIAEPIGVVAAVIPTTNPTSTAIFKTLLCLKTRNAIIISPHPRAKNCTIAAAKVVLDAAVAAGAPAGIIGWIDVPSLELTNEVMKNADIILATGGPGMVKAAYSSGKPALGVGAGNTPVIMDESCDVRLAVSSIIHSKTFDNGMICASEQSVIISDKIYEAAKKEFKDRGCHICSPEETQKLRETILINGALNAKIVGQSAHTIAKLAGFDVAEAAKILIGEVESVELEEQFAHEKLSPVLAMYKSKSFDDAVSKAARLVADGGYGHTSSIYINVGTGQEKIAKFSDAMKTCRILVNTPSSHGGIGDLYNFKLAPSLTLGCGSWGGNSVSENVGVKHLINIKTVAERRENMLWFRAPEKVYFKKGCLPVALAELKDVMNKKKVFIVTDAFLYKNGYTKCVTDQLDAMGIQHTTYYDVAPDPSLASATEGAEAMRLFEPDCIIALGGGSAMDAGKIMWVMYEHPEVNFLDLAMRFMDIRKRVYSFPKMGEKAYFIAVPTSSGTGSEVTPFAVITDERTGVKYPLADYELLPKMAIIDADMMMNQPKGLTSASGIDALTHALEAYASIMATDYTDGLALKAMKNIFAYLPSAYENGAADPVAREKMADASTLAGMAFANAFLGICHSMAHKLGAFHHLPHGVANALLINEVMRFNSVSIPTKMGTFSQYQYPHALDRYVECANFLGIAGKNDNEKFENLLKAIDELKEKVGIKKSIKEYGVDEKYFLDTLDAMVEQAFDDQCTGANPRYPLMKEIKEIYLKVYYGK

SEQ ID NO: 471 - protein, 910 aa, Bifidobacterium adolescentis AADH; identical to SEQ ID NO: 449

SEQ ID NO: 472 - protein, 885 aa, Piromyces sp. AADH
MSGLQMFQNLSLYGSLAEIDTSEKLNEAMDKLTAAQEQFREYNQEQVDKIFKAVALAASQNRVAFAKYAHEETQKGVFEDKVIKNEFAADYIYHKYCNDKTAGIIEYDEANGLMEIAEPVGPVVGIAPVTNPTSTIIYKSLIALKTRNCIIFSPHPGAHKASVFVVKVLHQAAVKAGAPENCIQIIFPKMDLTTELLHHQKTRFIWATGGPGLVHASYTSGKPALGGGPGNAPALIDETCDMNEAVGSIVVSKTFDCGMICATENAVVVVESVYENFVATMKKRGAYFMTPEETKKASNLLFGEGMRLNAKAVGQTAKTLAEMAGFEVPENTVVLCGEASEVKFEEPMAHEKLTTILGIYKAKDFDDGVRLCKELVTFGGKGHTAVLYTNQNNKDRIEKYQNEVPAFHILVDMPSSLGCIGDMYNFRLAPALTITCGTMGGGSSSDNIGPKHLLNIKRVGMRRENMLWFKIPKSVYFKRAILSEALSDLRDTHKRAIIITDRTMTMLGQTDKIIKACEGHGMVCTVYDKVVPDPTIKCIMEGVNEMNVFKPDLAIALGGGSAMDAAKMMRLFYEYPDQDLQDIATRFVDIRKRVVGCPKLGRLIKTLVCIPTTSGTGAEVTPFAVVTSEEGRKYPLVDYELTPDMAIVDPEFAVGMPKRLTSWTGIDALTHAIESYVSIMATDFTRPYSLRAVGLIFESLSLAYNNGKDIEAREKMHNASAIAGMAFANAFLGCCHSVAHQLGSVYHIPHGLANALMLSHIIKYNATDSPVKMGTFPQYKYPQAMRHYAEIAELLLPPTQVVKMTDVDKVQYLIDRVEQLKADVGIPKSIKETGMVTEEDFFNKVDQVAIMAFDDQCTGANPRYPLVSELKQLMIDAWNGVVPKL

SEQ ID NO: 473 - protein, 954 aa, Chlamydomonas reinhardtii AADH
MMSSSLVSGKRVAVPSAAKPCAAVPLPRVAGRRTAARVVCEAAPSGAAPASPKAEAAAPVAAAPATPHAEVKKERAPATDEALTELKALLKRAQTAQAQYSTYTQEQVDEIFRAAAEAANAARIPLAKMAVEETRMGVAEDKVVKNHFASEFIYNKYKHTKTCGVIEHDPAGGIQKVAEPVGVIAGIVPTTNPTSTAIFKSLLSLKTRNALVLCPHPRAAKSTIAAARIVRDAAVAAGAPPNIISWVETPSLPVSQALMQATEINLILATGGPAMVRAAYSSGNPSLGVGAGNTPALIDETADVAMAVSSILLSKTFDNGVICASEQSVVVVAKAYDAVRTEFVRRGAYFLTEDDKVKVRAGVVVDGKLNPNIVGQSIPKLAALFGIKVPQGTKVLIGEVEKIGPEEALSQEKLCPILAMYRAPDYDHGVKMACELIMYGGAGHTSVLYTNPLNNAHIQQYQSAVKTVRILINTPASQGAIGDLYNFHLDPSLTLGCGTWGSTSVSTNVGPQHLLNIKTVTARRENMLWFRVPPKIYFKGGCLEVALTDLRGKSRAFIVTDKPLFDMGYADKVTHILDSINVHHQVFYHVTPDPTLACIEAGLKEILEFKPDVIIALGGGSPMDAAKIMWLMYECPDTRFDGLAMRFMDIRKRVYEVPELGKKATMVCIPTTSGTGSEVTPFSVVTDERLGAKYPLADYALTPSMAIVDPQLVLNMPKKLTAWGGIDALTHALESYVSICATDYTKGLSREAISLLFKYLPRAYANGSNDYLAREKVHYAATIAGMAFANAFLGICHSMAHKLGAAYHVPHGLANAALISHVIRYNATDMPAKQAAFPQYEYPTAKQDYADLANMLGLGGNTVDEKVIKLIEAVEELKAKVDIPPTIKEIFNDPKVDADFLANVDALAEDAFDDQCTGANPRYPLMADLKQLYLDAHAAPILPVKTLEFFSKIN

SEQ ID NO: 474 - protein, 862 aa, Thermoanaerobacterium saccharolyticum AADH
MFIMATTKTELDVQKQIDLLVSRAQEAQKKFMSYTQEQIDAIVKAMALAGVDKHVELAKMAYEETKMGVYEDKITKNLFATEYVYHDIKNEKTVGIINENIEENYMEVAEPIGVIAGVTPVTNPTSTTMFKCLISIKTRNPIIFSFHPKAIKCSIAAAKVMYEAALKAGAPEGCIGWIETPSIEATQLLMTHPGVSLILATGGAGMVKAAYSSGKPALGVGPGNVPCYIEKSANIKRAVSDLILSKTFDNGVICASEQAVIIDEEIADEVKKLMKEYGCYFLNKDEIKKLEKFAIDEQSCAMSPAVVGQPAAKIAEMAGFKVPEGTKILVAEYEGVGPKYPLSREKLSPILACYTVKDYNEGIKKCEEMTEFGGLGHSAVIHSENQNVINEFARRVRTGRLIVNSPSSQGAIGDIYNTNTPSLTLGCGSMGRNSTTDNVSVKNLLNIKRVVIRNDRMKWFKIPPKIYFESGSLQYLCKVKRKKAFIVTDPFMVKLGFVDKVTYQLDKANIEYEIFSEVEPDPSVDTVMNGVKIMNSYNPDLIIAVGGGSAIDAAKGMWLFYEYPDTEFETLRLKFADIRKRAFKFPELGKKALFIAIPTTSGTGSEVTAFAVITDKKRNIKYPLADYELTPDIAIIDPDLTKTVPPSVTADTGMDVLTHAIEAYVSVMASDYTDALAEKAIKIVFEYLPRAYKNGNDEEAREKMHNASCMAGMAFTNAFLGINHSMAHILGGKFHIPHGRANAILLPYVIRYNAEKPTKFVAFPQYEYPKAAERYAEIAKFLGLPASTVEEGVESLIEAIKNLMKELNIPLTLKDAGINKEQFEKEIEEMSDIAFNDQCTGTNPRMPLTKEIAEIYRKAYGA

SEQ ID NO: 475 - protein, 515 aa, Clostridium phytofermentans ADH alcohol dehydrogenase
MENFDFDLRSIQEARDLARSGEAAAKKIAQFSEEQIDRILKSMAKAGEEHALCLGEMASEETGFGKAMDKAYKNHAASTLLYEEIKDMKTRGILAEDTVNKTIDVAEPVGLVMGIVPSTNPTSTVFFKSMVAVKSGNAIVFSPHPSAAKCTLKAAEIMRDAAIAAGAPEGIIGCVTMPSMGSTNELMKCKEVSVIIATGGPAMVKAAYSAGKPAIGVGAGNSPAYIEKTADVKQAVKTIIASKTFDYGTICASEQSIICEESNEAEVLAELKSQGGYFMTKEETDKVCGLLFKNGYTMNAKFVGRSPQVIAQAAGIEIPMDTKVLIGRQEGVGQGYPLSFEKLTTVLGFYTVKDCHEACDLSIRLLQNGIGHTMSIHTQDRDMVLKFAAKPASRILVNTGGSQGGTGISTGLPISFTLGCGTCGGSSVSENVSPKHLLNVKKVAFGLKDCSTIAADDETFTWKEKAGTNSCSPADFVASFVKKEGTTANSCQGSCDDNEKLAALVKEIVLAMKGQ

SEQ ID NO: 476 - protein, 495 aa, Clostridium phytofermentans ADH alcohol dehydrogenase
MELQEKDLMSIQEVRLLLKTAKEAHKILSTFNQEQIDRIVKAITEACLKNAERLAKMANEETGFGIWQDKVIKNVFGSMGIYEAIKDMKTIGILREDKKNQTMEIGIPVGIVAGVIPSTNPTSTVMYKTLISIKAGNCIVFSPHPGAKKCILETVKVICEAAEAAGCPKGAISCISIPTLEATNELMKHPNTNLILATGGYAMVKSAYSSGTPAIGVGAGNGPAFIDKTANVKLAVKRIMDSKTFDNGTICASEQSVIVERCMEQAVKEELTAQGGFFLNEAESEKLARFILRANGTMNPQIVGRSVAHISKLAGLTTVPANARVLIAKETRVGDEAPYSREKLAPILAFFVEETVDDVINKVVEILSFEGMGHTFTMHSTNEELIKRFALRVPASRILVNSMGSLGGVGASTNLFPALTLGCGAVGGSSSSNNIGPMDLINIKRVAFGVKELEEIKRDATNSLGETKSSCCGAYGNVNTELVEEIVKRIMKQLI

SEQ ID NO: 477 - DNA, 759 bp, Bifidobacterioum adolescentis pflA (codon optomized)
atggatggaaatattcattcgatcgaaacattcggcaccgttgacggtccaggcatcaggtatgtcgtcttcacacaaggctgcctgatgcgctgtcaattttgccataatgctgatacttgggaaatcggaaccggaaaacaaatgacggtttccgaaatcgttcaggatgtccagcattatctcccgtttattcaatcatcgggcggaggcatcaccgtgagcggaggcgagccgcttttacaactgccgtttttaatcgagctgttcaaagcatgcaaaagcctcggcattcacacggcactcgattcgtccggcggatgctattcggctgcgccggcatttcaagagcagatcaaagaactgatccagtatacagaccttgttttgcttgacctcaagcatcacaacagaaaaaaacatatcaacctgacaggaatgccgaatgaccacattttagaatttgcccggtttctcgctgaacatcaagttcccgtctggatccgccacgtactggttccggggatctccgatatcgatgccgatttaacggccctcggcacgtttatcggcacgcttgcgaacgttcagaaggtggaggttcttccttatcacaagctcggcgtctacaaatgggaagcgcttggcctggattatccgttaaaaggggttgaaccgccaagtgccgacagggccgaaaatgcgtacagactgctcaccgcacacttgcaaggcggatccttgctgcaagagacataa

SEQ ID NO: 478 - DNA, 2226 bp, Bifidobacterioum adolescentis pflB pyruvate formate lyase
atggaacaatggaaaggtttcaccacaaacgtttggcaaaaagaagtcaatgtccgcgattttattctctcgaactttgagccatatcaaggtgacgaatcgtttctcgaacctccgacggaagctacatcggcattatgggatcatgtaatggatttgacaaaaaaagagcgtgaaaacggaggcgtccttgatatggatacagagatcgtctcaacgatcacctcgcacggtcccggatatttgaacaaagacctggaaaaagtcgtcggcgttcaaaccgatgagccgtttaaacggtcgcttcagcctttcggcggcatccgaatggcaaagcaggcatgcgaatcctatggttttaaactgaatgaagaagtggaaaggatctttaccgattaccgcaaaactcataaccaaggcgtgtttgacgcatatacggacgaaatgaagctcgcccgaaaagtcggaatcattaccggactgcctgatgcttacgggcgcgggcgcatcatcggtgattaccggagagtggcgctttacggcgtggatttcttgatcgatgaaaagaaaaaagatgcggccggcacctctcgggtgatgtctgaagaaaacatccgccttcgtgaagaactgtcagaacaaatccgagcattgaacgaacttaaagcgcttgcaaaaagctatgggtttgacatttccaagcctgcggcgaatgcaagagaagcatttcaatggctgtattttgcctatttggctgccattaaagagcaaaacggagcagcaatgagccttggccgcgtgtccacgttccttgatatttacatcgaaagagatttgaaaacgggcgtattaacagagcgtgaagcccaagagcttgtcgaccatttcgtcatgaagctgcgtttggtcaaattcgcgcgcacacctgactacaatgaactgttcagcggcgatccgacgtgggtgacagaatcaatcggcggaatggcgcacgacggacgcgccctggtgacgaaaaactcgttccgtttcctgcatacgcttgacaatttaggcccggcgcctgaaccgaatttaaccgttctttggtctgtcagactgccgcaaaagtttaaaaactactgtgccaaaatgtcgattaaaacaagctcgatccaatacgaaaatgacgatatcatgcgtccagaatacggtgatgactacggaatcgcctgctgtgtatcggcaatggcaatcggcaaacaaatgcagttcttcggagcacgcgccaacttggcgaaagctcttttatatgcgattaacggcggaaaagacgaaaagcataaaatgcaagtcggtccggaaatgccgccggttgcttccgacgtgctggactatgacgaagtgatgcataaattcgatcagacgatggaatggctcgcaggcttgtacatcaacacgctcaatgtcattcactacatgcatgataaatattgctatgaaagaattgaaatggccctgcacgacacggaaattttgcggacgatggccactgggatcgccggcttgagtgttgtcgccgattcattaagcgctgtcaaatatgccaaagtcagcgtggtccgcgatgaaaacggcattgcggtcgattttgaaacagaaggcgactttcctaagtacggaaataacgatgaccgcgtcgacgcgatcgccgttgacattgtcaagcgctttatgaaaaaactgcgcaagcatcagacatatcgccagtccgttcagaccatgtcaattttaacgatcacgtcaaacgtcgtttacggcaagaaaaccggaaatacgccggatggacgccgcgcgggagaaccgtttgctccaggtgcgaatccgatgcacggccgcgatactaaagggacgcttgcatcgctgtcttcagtggcaaagctgccttacagctatgcgctcgacggcatttccaacaccttttcaatcgtcccgaaagcgcttggcaaagacgaagagagccgcgccgccaatttgtcaagcatccttgacggatatgccgcaaaaacaggacatcacttaaatgtaaacgtatttaacagagagacactgctcgacgccatggaacatccagaggaatatccgcagttaacgattcgcgtctcaggctatgcggtcaactttattaagctgacgaaagaacagcagttagacgtcatcagcagaaccttccatgaatcgatgtag

SEQ ID NO: 479 - DNA, 2733 bp, Bifidobacterioum adolescentis AdhE
atggcagacgcaaagaagaaggaagagccgaccaagccgactccggaagagaagctcgccgcagccgaggctgaggtcgacgctctggtcaagaagggcctgaaggctcttgatgaattcgagaagctcgatcagaagcaggttgaccacatcgtggccaaggcttccgtcgcagccctgaacaagcacttggtgctcgccaagatggccgtcgaggagacccaccgtggtctggtcgaagacaaggccaccaagaacatcttcgcctgcgagcatgtcaccaactacctggctggtcagaagaccgtcggcatcatccgcgaggacgacgtgctgggcatcgacgaaatcgccgagccggttggcgtcgtcgctggcgtgaccccggtcaccaacccgacctccaccgccatcttcaagtcgctgatcgcactgaagacccgctgcccgatcatcttcggcttccacccgggcgcacagaactgctccgtcgcggccgccaagatcgttcgcgatgccgctatcgcagcaggcgctcctgagaactgtattcagtggatcgagcatccgtccatcgaggccactggcgccctgatgaagcatgatggtgtcgccaccatcctcgccaccggtggtccgggcatggtcaaggccgcatactcctccggcaagccggccctgggcgtcggcgcgggcaatgctccggcatacgttgacaagaacgtcgacgtcgtgcgtgcagccaacgatctgattctttccaagcacttcgattacggcatgatctgcgctaccgagcaggccatcatcgccgacaaggacatctacgctccgctcgttaaggaactcaagcgtcgcaaggcctatttcgtgaacgctgacgagaaggccaagctcgagcagtacatgttcggctgcaccgcttactccggacagaccccgaagctcaactccgtggtgccgggcaagtccccgcagtacatcgccaaggccgccggcttcgagattccggaagacgccaccatccttgccgctgagtgcaaggaagtcggcgagaacgagccgctgaccatggagaagcttgctccggtccaggccgtgctgaagtccgacaacaaggaacaggccttcgagatgtgcgaagccatgctgaagcatggcgccggccacaccgccgccatccacaccaacgaccgtgacctggtccgcgagtacggccagcgcatgcacgcctgccgtatcatctggaactccccgagctccctcggcggcgtgggcgacatctacaacgccatcgctccgtccctgaccctgggctgcggctcctacggcggcaactccgtgtccggcaacgtccaggcagtcaacctcatcaacatcaagcgcatcgctcggaggaacaacaacatgcagtggttcaagattccggccaagacctacttcgagccgaacgccatcaagtacctgcgcgacatgtacggcatcgaaaaggccgtcatcgtgtgcgataaggtcatggagcagctcggcatcgttgacaagatcatcgatcagctgcgtgcacgttccaaccgcgtgaccttccgtatcatcgattatgtcgagccggagccgagcgtggagaccgtcgaacgtggcgccgccatgatgcgcgaggagttcgagccggataccatcatcgccgtcggcggtggttccccgatggatgcgtccaagattatgtggctgctgtacgagcacccggaaatctccttctccgatgtgcgtgagaagttcttcgatatccgtaagcgcgcgttcaagattccgccgctgggcaagaaggccaagctggtctgcattccgacttcttccggcaccggttccgaagtcacgccgttcgctgtgattaccgaccacaagaccggctataagtacccgatcaccgattacgcgctgaccccgtccgtcgctatcgtcgatccggtgctggcacgtactcagccgcgcaagctggcttccgatgctggtttcgatgctctgacccacgcttttgaggcttatgtgtccgtgtatgccaacgacttcaccgatggtatggcattgcacgctgccaagctggtttgggacaacctcgctgagtccgtcaatggcgagccgggtgaggagaagacccgtgcccaggagaagatgcataatgccgccaccatggccggcatggctttcggctccgccttcctcggcatgtgccacggcatggcccacaccattggtgcactgtgccacgttgcccacggtcgtaccaactccatcctcctgccgtacgtgatccgttacaacggttccgtcccggaggagccgaccagctggccgaagtacaacaagtacatcgctccggaacgctaccaggagatcgccaagaaccttggcgtgaacccgggcaagactccggaagagggcgtcgagaacctggccaaggctgttgaggattaccgtgacaacaagctcggtatgaacaagagcttccaggagtgcggtgtggatgaggactactattggtccatcatcgaccagatcggcatgcgcgcctacgaagaccagtgcgcaccggcgaacccgcgtatcccgcagatcgaggatatgaaggatatcgccattgccgcctactacggcgtcagccaggcggaaggccacaagctgcgcgtccagcgtcagggcgaagccgctacggaggaagcttccgagcgcgcctga

SEQ ID NO: 480 - DNA, 2583 bp, Aspergillus niger Bgl1 beta-glucosidase
atgaggttcactttgatcgaggcggtggctctgactgccgtctcgctggccagcgctgatgaattggcctactccccaccgtattacccatccccttgggccaatggccagggcgactgggcgcaggcataccagcgcgctgttgatattgtctcgcaaatgacattggatgagaaggtcaatctgaccacaggaactggatgggaattggaactatgtgttggtcagactggcggtgttccccgattgggagttccgggaatgtgtttacaggatagccctctgggcgttcgcgactccgactacaactctgctttccctgccggcatgaacgtggctgcaacctgggacaagaatctggcataccttcgcggcaaggctatgggtcaggaatttagtgacaagggtgccgatatccaattgggtccagctgccggccctctcggtagaagtcccgacggtggtcgtaactgggagggcttctccccagaccctgccctaagtggtgtgctctttgccgagaccatcaagggtatccaagatgctggtgtggttgcgacggctaagcactacattgcttacgagcaagagcatttccgtcaggcgcctgaagcccaaggttttggatttaatatttccgagagtggaagtgcgaacctcgatgataagactatgcacgagctgtacctctggcccttcgcggatgccatccgtgcaggtgctggcgctgtgatgtgctcctacaaccagatcaacaacagttatggctgccagaacagctacactctgaacaagctgctcaaggccgagctgggcttccagggctttgtcatgagtgattgggctgctcaccatgctggtgtgagtggtgctttggcaggattggatatgtctatgccaggagacgtcgactacgacagtggtacgtcttactggggtacaaacttgaccattagcgtgctcaacggaacggtgccccaatggcgtgttgatgacatggctgtccgcatcatggccgcctactacaaggtcggccgtgaccgtctgtggactcctcccaacttcagctcatggaccagagatgaatacggctacaagtactactacgtgtcggagggaccgtacgagaaggtcaaccagtacgtgaatgtgcaacgcaaccacagcgaactgattcgccgcattggagcggacagcacggtgctcctcaagaacgacggcgctctgcctttgactggtaaggagcgcctggtcgcgcttatcggagaagatgcgggctccaacccttatggtgccaacggctgcagtgaccgtggatgcgacaatggaacattggcgatgggctggggaagtggtactgccaacttcccatacctggtgacccccgagcaggccatctcaaacgaggtgcttaagcacaagaatggtgtattcaccgccaccgataactgggctatcgatcagattgaggcgcttgctaagaccgccagtgtctctcttgtctttgtcaacgccgactctggtgagggttacatcaatgtggacggaaacctgggtgaccgcaggaacctgaccctgtggaggaacggcgataatgtgatcaaggctgctgctagcaactgcaacaacacaatcgttgtcattcactctgtcggaccagtcttggttaacgagtggtacgacaaccccaatgttaccgctatcctctggggtggtttgcccggtcaggagtctggcaactctcttgccgacgtcctctatggccgtgtcaaccccggtgccaagtcgccctttacctggggcaagactcgtgaggcctaccaagactacttggtcaccgagcccaacaacggcaacggagcccctcaggaagactttgtcgagggcgtcttcattgactaccgtggatttgacaagcgcaacgagaccccgatctacgagttcggctatggtctgagctacaccactttcaactactcgaaccttgaggtgcaggtgctgagcgcccctgcatacgagcctgcttcgggtgagaccgaggcagcgccaaccttcggagaggttggaaatgcgtcggattacctctaccccagcggattgcagagaattaccaagttcatctacccctggctcaacggtaccgatctcgaggcatcttccggggatgctagctacgggcaggactcctccgactatcttcccgagggagccaccgatggctctgcgcaaccgatcctgcctgccggtggcggtcctggcggcaaccctcgcctgtacgacgagctcatccgcgtgtcagtgaccatcaagaacaccggcaaggttgctggtgatgaagttccccaactgtatgtttcccttggcggtcccaatgagcccaagatcgtgctgcgtcaattcgagcgcatcacgctgcagccgtcggaggagacgaagtggagcacgactctgacgcgccgtgaccttgcaaactggaatgttgagaagcaggactgggagattacgtcgtatcccaagatggtgtttgtcggaagctcctcgcggaagctgccgctccgggcgtctctgcctactgttcactaa

SEQ ID NO: 481 - DNA, 2877 bp, Debaryomyces occidentalis gam1 alpha-glucosidase glucoamylase
atgatttttctgaagctgattaaaagtatagtaattggtttgggattagttagtgctatccaagcagcccctgcctcttcgattggatctagtgcttcagcatctagttcaagtgagagttctcaggctacaattcccaatgatgtaacattaggtgttaaacaaattcctaatatctttaatgactctgctgtcgatgctaatgcagctgctaaagggtatgacttggtaaatgttactaatactccaagaggattaaccggtatcttaaaattaaaagaagctaccaatatttatggttatgattttgattatttaaacttaactgttgaataccaagctgataccagattaaacgttcatattgaaccaactgatttatctgatgtatttgttttaccagagcatttagttgttaaaccactggtggaaggtgatgcacaatcttataacttcgacaattccgatttggttttcgaatactctaatactgacttctcctttgaagttattagatcatctactaaagaagttttattttctactaaaggtaatccattggttttttcaaatcaattcattcaattcaattcgtcattgccaaagaaccatgttattactggtcttggtgaatctattcacggtttagttaacgaaccaggtagcgttaaaacattatttgctaatgatgttggtgatccaatcgatggtaatatttatggtgtccatccagtttatcttgatcaaagatatgacactgaaactacccatgctgtttattggagaacttctgctattcaagaagtattaatcggtgaggaatctattacttggagagctctttcaggtgttattgatttatacttctttagtggtcctacaccaaaagatgccattcaacagtatgtcaaagagattggtttaccagctttccaaccatactggtcgttaggttaccatcaatgtagatggggttacgatactatcgaaaaattatctgaagttgttgaaaacttcaagaaatttaatattccattagaaactatctggtcagacattgattacatggactcttataaagatttcacttatgatccacacagattcccactagatgaatatcgtaaattccttgatgagttgcacaaaaataatcaacactatgttcctattttggatgctgctatttacgttccaaacccaaacaatgctacggataacgaataccaacctttccactatggtaatgaaaccgatgtcttcttaaagaatccagatggttcattatatattggtgctgtttggcaggttacactgttttccagatttcttagcagaaaacattcagatatggataaagtcattaaagattggtatgaattaactccttttgatggtatttgggctgatatgaatgaagtctcatcattctgtgttggttcttgtggtactggtaaatacttcgaaaacccagcatatcctccatttactgttggaagtaaagctacctcttatccagttggtttcgatgtttctaacgcatctgaatggaaatctattcaaagctcaatttctgctactgctaagacttcttcaacttcttccgtatcgtcgtcttcatccacaatcgattatatgaacactttagctccaggtaaaggtaatattaattatccaccatatgctatttacaacatgcaaggtgactccgatcttgctactcatgcagtatctccaaatgctacacatgctgatggtacagttgaatatgatattcacaatctttatggttacttgcaagaaaatgctacttatcatgcattattggaagtttttcctaacaagagaccattcatgatttccagatcaacctttccacgcgctggtaaatggaccggccattggggtggtgacaacactgctgattgggcttatgcttacttctctatccctcaagcattctcaatgggtattgctggccttccattctttggtgccgatgtttgtggtttcaatggtaattctgattctgaattatgttcaagatggatgcaattaggttctttcttcccattctacagaaaccacaactatttaggtgctattgatcaggaaccatatgtctgggaatcagttgctgaagctactagaacttctatggccattagatacttattattaccatattactacactttattacatgaatctcatactactggtttaccaatcttaagagctttctcgtggcaattccctaacgatcgttccttaagtggtgtcgataaccaattttttgtcggtgatggtttagttgttactcctgtcttagaacctggtgttgataaggttaaaggtgttttcccaggagctggtaaagaggaagtttactacgactggtacacccaaagagaagttcactttaaagacggtaagaatgaaactttagatgcaccattaggtcatattccattacacattagaggtggtaacgtcttgccaactcaagagccaggttatactgttgctgagtcaagacaaaatccatttggtttaattgtcgctttagataacgatggcaaagctcaaggtagcttataccttgatgatggtgaatcattagtagtagactcttcattgttggttagtttctctgtttctgataacacattatcagcatctccatctggtgactataaagctgatcaacctttagctaatgttaccatcttaggggttggccataaaccaaaatcagttaaatttgaaaacgctaatgttgatttcacctacaagaaatcaaccgttttcgttactggcttagataaatacaccaaggatggtgcattttctaaggatttcaccattacttggtaa

SEQ ID NO: 482 - DNA, 1317 bp, Bacteroides thetaiotaomicron XI xylose isomerase
atggcaacaaaagaattttttccgggaattgaaaagattaaatttgaaggtaaagatagtaagaacccgatggcattccgttattacgatgcagagaaggtgattaatggtaaaaagatgaaggattggctgagattcgctatggcatggtggcacacattgtgcgctgaaggtggtgatcagttcggtggcggaacaaagcaattcccatggaatggtaatgcagatgctatacaggcagcaaaagataagatggatgcaggatttgaattcatgcagaagatgggtatcgaatactattgcttccatgacgtagacttggtttcggaaggtgccagtgtagaagaatacgaagctaacctgaaagaaatcgtagcttatgcaaaacagaaacaggcagaaaccggtatcaaactactgtggggtactgctaatgtattcggtcacgcccgctatatgaacggtgcagctaccaatcctgacttcgatgtagtagctcgtgctgctgttcagatcaaaaatgcgattgatgcaacgattgaacttggcggagagaattatgtgttttggggtggtcgtgaaggctatatgtctcttctgaacacagatcagaaacgtgaaaaagaacaccttgcacagatgttgacgattgctcgtgactatgcccgtgcccgtggtttcaaaggtactttcctgatcgaaccgaaaccgatggaaccgactaaacatcaatatgacgtagatacggaaactgtaatcggcttcctgaaagctcatggtctggataaggatttcaaagtaaatatcgaggtgaatcacgcaactttggcaggtcacactttcgagcatgaattggctgtagctgtagacaatggtatgttgggctcaattgacgccaatcgtggtgactatcagaatggctgggatacagaccaattcccgatcgacaattatgaactgactcaggctatgatgcagattatccgtaatggtggtctcggtaccggtggtacgaactttgatgctaaaacccgtcgtaattctactgatctggaagatatctttattgctcacatcgcaggtatggacgctatggcccgtgcactcgaaagtgcagcggctctgctcgacgaatctccctataagaagatgctggctgaccgttatgcttcatttgatgggggcaaaggtaaagaatttgaagacggcaagctgactctggaggatgtggttgcttatgcaaaaacaaaaggcgaaccgaaacagactagcggcaagcaagaactttatgaggcaattctgaatatgtattgctaa

SEQ ID NO: 483 - DNA, 1803 bp, Saccharomyces cerevisiae XK xylulokinase
atgttgtgttcagtaattcagagacagacaagagaggtttccaacacaatgtctttagactcatactatcttgggtttgatctttcgacccaacaactgaaatgtctcgccattaaccaggacctaaaaattgtccattcagaaacagtggaatttgaaaaggatcttccgcattatcacacaaagaagggtgtctatatacacggcgacactatcgaatgtcccgtagccatgtggttagaggctctagatctggttctctcgaaatatcgcgaggctaaatttccattgaacaaagttatggccgtctcagggtcctgccagcagcacgggtctgtctactggtcctcccaagccgaatctctgttagagcaattgaataagaaaccggaaaaagatttattgcactacgtgagctctgtagcatttgcaaggcaaaccgcccccaattggcaagaccacagtactgcaaagcaatgtcaagagtttgaagagtgcataggtgggcctgaaaaaatggctcaattaacagggtccagagcccattttagatttactggtcctcaaattctgaaaattgcacaattagaaccagaagcttacgaaaaaacaaagaccatttctttagtgtctaattttttgacttctatcttagtgggccatcttgttgaattagaggaggcagatgcctgtggtatgaacctttatgatatacgtgaaagaaaattcagtgatgagctactacatctaattgatagttcttctaaggataaaactatcagacaaaaattaatgagagcacccatgaaaaatttgatagcgggtaccatctgtaaatattttattgagaagtacggtttcaatacaaactgcaaggtctctcccatgactggggataatttagccactatatgttctttacccctgcggaagaatgacgttctcgtttccctaggaacaagtactacagttcttctggtcaccgataagtatcacccctctccgaactatcatcttttcattcatccaactctgccaaaccattatatgggtatgatttgttattgtaatggttctttggcaagggagaggataagagacgagttaaacaaagaacgggaaaataattatgagaagactaacgattggactctttttaatcaagctgtgctagatgactcagaaagtagtgaaaatgaattaggtgtatattttcctctgggggagatcgttcctagcgtaaaagccataaacaaaagggttatcttcaatccaaaaacgggtatgattgaaagagaggtggccaagttcaaagacaagaggcacgatgccaaaaatattgtagaatcacaggctttaagttgcagggtaagaatatctcccctgctttcggattcaaacgcaagctcacaacagagactgaacgaagatacaatcgtgaagtttgattacgatgaatctccgctgcgggactacctaaataaaaggccagaaaggactttttttgtaggtggggcttctaaaaacgatgctattgtgaagaagtttgctcaagtcattggtgctacaaagggtaattttaggctagaaacaccaaactcatgtgcccttggtggttgttataaggccatgtggtcattgttatatgactctaataaaattgcagttccttttgataaatttctgaatgacaattttccatggcatgtaatggaaagcatatccgatgtggataatgaaaattgggatcgctataattccaagattgtccccttaagcgaactggaaaagactctcatctaa

SEQ ID NO: 484 - DNA, 714 bp, Saccharomyces cerevisiae rpe ribulose-phosphate 3-epimerase
atggtcaaaccaattatagctcccagtatccttgcttctgacttcgccaacttgggttgcgaatgtcataaggtcatcaacgccggcgcagattggttacatatcgatgtcatggacggccattttgttccaaacattactctgggccaaccaattgttacctccctacgtcgttctgtgccacgccctggcgatgctagcaacacagaaaagaagcccactgcgttcttcgattgtcacatgatggttgaaaatcctgaaaaatgggtcgacgattttgctaaatgtggtgctgaccaatttacgttccactacgaggccacacaagaccctttgcatttagttaagttgattaagtctaagggcatcaaagctgcatgcgccatcaaacctggtacttctgttgacgttttatttgaactagctcctcatttggatatggctcttgttatgactgtggaacctgggtttggaggccaaaaattcatggaagacatgatgccaaaagtggaaactttgagagccaagttcccccatttgaatatccaagtcgatggtggtttgggcaaggagaccatcccgaaagccgccaaagccggtgccaacgttattgtcgctggtaccagtgttttcactgcagctgacccgcacgatgttatctccttcatgaaagaagaagtctcgaaggaattgcgttctagagatttgctagat

SEQ ID NO: 485 - DNA, 774 bp, Saccharomyces cerevisiae rpi ribose 5-phosphate isomerase
atggctgccggtgtcccaaaaattgatgcgttagaatctttgggcaatcctttggaggatgccaagagagctgcagcatacagagcagttgatgaaaatttaaaatttgatgatcacaaaattattggaattggtagtggtagcacagtggtttatgttgccgaaagaattggacaatatttgcatgaccctaaattttatgaagtagcgtctaaattcatttgcattccaacaggattccaatcaagaaacttgattttggataacaagttgcaattaggctccattgaacagtatcctcgcattgatatagcgtttgacggtgctgatgaagtggatgagaatttacaattaattaaaggtggtggtgcttgtctatttcaagaaaaattggttagtactagtgctaaaaccttcattgtcgttgctgattcaagaaaaaagtcaccaaaacatttaggtaagaactggaggcaaggtgttcccattgaaattgtaccttcctcatacgtgagggtcaagaatgatctattagaacaattgcatgctgaaaaagttgacatcagacaaggaggttctgctaaagcaggtcctgttgtaactgacaataataacttcattatcgatgcggatttcggtgaaatttccgatccaagaaaattgcatagagaaatcaaactgttagtgggcgtggtggaaacaggtttattcatcgacaacgcttcaaaagcctacttcggtaattctgacggtagtgttgaagttaccgaaaag

SEQ ID NO: 486 - DNA, 2040 bp, Saccharomyces cerevisiae tkl transketolase
atgactcaattcactgacattgataagctagccgtctccaccataagaattttggctgtggacaccgtatccaaggccaactcaggtcacccaggtgctccattgggtatggcaccagctgcacacgttctatggagtcaaatgcgcatgaacccaaccaacccagactggatcaacagagatagatttgtcttgtctaacggtcacgcggtcgctttgttgtattctatgctacatttgactggttacgatctgtctattgaagacttgaaacagttcagacagttgggttccagaacaccaggtcatcctgaatttgagttgccaggtgttgaagttactaccggtccattaggtcaaggtatctccaacgctgttggtatggccatggctcaagctaacctggctgccacttacaacaagccgggctttaccttgtctgacaactacacctatgttttcttgggtgacggttgtttgcaagaaggtatttcttcagaagcttcctccttggctggtcatttgaaattgggtaacttgattgccatctacgatgacaacaagatcactatcgatggtgctaccagtatctcattcgatgaagatgttgctaagagatacgaagcctacggttgggaagttttgtacgtagaaaatggtaacgaagatctagccggtattgccaaggctattgctcaagctaagttatccaaggacaaaccaactttgatcaaaatgaccacaaccattggttacggttccttgcatgccggctctcactctgtgcacggtgccccattgaaagcagatgatgttaaacaactaaagagcaaattcggtttcaacccagacaagtcctttgttgttccacaagaagtttacgaccactaccaaaagacaattttaaagccaggtgtcgaagccaacaacaagtggaacaagttgttcagcgaataccaaaagaaattcccagaattaggtgctgaattggctagaagattgagcggccaactacccgcaaattgggaatctaagttgccaacttacaccgccaaggactctgccgtggccactagaaaattatcagaaactgttcttgaggatgtttacaatcaattgccagagttgattggtggttctgccgatttaacaccttctaacttgaccagatggaaggaagcccttgacttccaacctccttcttccggttcaggtaactactctggtagatacattaggtacggtattagagaacacgctatgggtgccataatgaacggtatttcagctttcggtgccaactacaaaccatacggtggtactttcttgaacttcgtttcttatgctgctggtgccgttagattgtccgctttgtctggccacccagttatttgggttgctacacatgactctatcggtgtcggtgaagatggtccaacacatcaacctattgaaactttagcacacttcagatccctaccaaacattcaagtttggagaccagctgatggtaacgaagtttctgccgcctacaagaactctttagaatccaagcatactccaagtatcattgctttgtccagacaaaacttgccacaattggaaggtagctctattgaaagcgcttctaagggtggttacgtactacaagatgttgctaacccagatattattttagtggctactggttccgaagtgtctttgagtgttgaagctgctaagactttggccgcaaagaacatcaaggctcgtgttgtttctctaccagatttcttcacttttgacaaacaacccctagaatacagactatcagtcttaccagacaacgttccaatcatgtctgttgaagttttggctaccacatgttggggcaaatacgctcatcaatccttcggtattgacagatttggtgcctccggtaaggcaccagaagtcttcaagttcttcggtttcaccccagaaggtgttgctgaaagagctcaaaagaccattgcattctataagggtgacaagctaatttctcctttgaaaaaagctttc

SEQ ID NO: 487 - DNA, 1005 bp, Saccharomyces cerevisiae tal transkaldolase
atgtctgaaccagctcaaaagaaacaaaaggttgctaacaactctctagaacaattgaaagcctccggcactgtcgttgttgccgacactggtgatttcggctctattgccaagtttcaacctcaagactccacaactaacccatcattgatcttggctgctgccaagcaaccaacttacgccaagttgatcgatgttgccgtggaatacggtaagaagcatggtaagaccaccgaagaacaagtcgaaaatgctgtggacagattgttagtcgaattcggtaaggagatcttaaagattgttccaggcagagtctccaccgaagttgatgctagattgtcttttgacactcaagctaccattgaaaaggctagacatatcattaaattgtttgaacaagaaggtgtctccaaggaaagagtccttattaaaattgcttccacttgggaaggtattcaagctgccaaagaattggaagaaaaggacggtatccactgtaatttgactctattattctccttcgttcaagcagttgcctgtgccgaggcccaagttactttgatttccccatttgttggtagaattctagactggtacaaatccagcactggtaaagattacaagggtgaagccgacccaggtgttatttccgtcaagaaaatctacaactactacaagaagtacggttacaagactattgttatgggtgcttctttcagaagcactgacgaaatcaaaaacttggctggtgttgactatctaacaatttctccagctttattggacaagttgatgaacagtactgaacctttcccaagagttttggaccctgtctccgctaagaaggaagccggcgacaagatttcttacatcagcgacgaatctaaattcagattcgacttgaatgaagacgctatggccactgaaaaattgtccgaaggtatcagaaaattctctgccgatattgttactctattcgacttgattgaaaagaaagttaccgct

SEQ ID NO: 488 - DNA, 2676 bp, Escherichia coli AADH
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagtctgaagacccgtaacgccattatcttctccccgcacccgcgtgcaaaagatgccaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggcaacactccagttgttatcgatgaaactgctgatatcaaacgtgcagttgcatctgtactgatgtccaaaaccttcgacaacggcgtaatctgtgcttctgaacagtctgttgttgttgttgactctgtttatgacgctgtacgtgaacgttttgcaacccacggcggctatctgttgcagggtaaagagctgaaagctgttcaggatgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggcgcgtatcctgattaacaccccagcgtctcagggtggtatcggtgacctgtataacttcaaactcgcaccttccctgactctgggttgtggttcttggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaagagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatatccgctggcagactatgcgctgactccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacttgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaaggtgaaactgcagcgaagaaagaagctgctccggctaaagctgagaaaaaagcgaaaaaatccgcttaa

SEQ ID NO: 489 - DNA, 2619 bp, Clostridium phytofermentans AADH
atgacgaaaaaagtggaattacagacaactggattagtagactctctcgaagcattaacagcaaaatttagagagttaaaagaagcacaagagctctttgctacctacactcaagagcaagtagataaaatcttctttgctgctgccatggctgccaatcagcaacgtattccgttagcaaagatggctgtagaagaaacgggtatgggtattgtagaagataaagtaattaagaatcattatgctgcagagtatatttacaatgcatacaaagatacaaaaacatgtggagtggttgaagaagatcctagcttcggtatcaaaaaaattgcagagccaatcggcgtagttgcagctgtaatcccaactaccaatcctacctccactgctatctttaaaacattactttgtttaaagactcgtaacgcaatcatcatcagcccacatcctcgtgctaagaactgtaccatcgcagctgctaaggtagttttagatgctgcagttgctgcaggtgctcctgctggtataattggatggattgatgttccatcacttgaattaaccaatgaagttatgaaaaatgcagacatcatccttgcaactggtggacctggtatggtaaaggctgcttattcttctggtaaaccagcacttggtgttggcgcaggtaatacccctgttattatggatgaaagctgcgatgttcgccttgcagtaagctctattattcactctaagacatttgataacggtatgatttgtgcttccgagcaatccgtaattattagtgataagatttatgaagctgctaagaaagaattcaaggatcgtggttgccacatctgctccccagaagagactcagaagcttcgtgaaacaatcctaattaatggtgctcttaacgctaaaattgttggacaaagcgctcatacgattgcaaagcttgcaggatttgatgtagcagaagctgctaagattttaattggtgaagtagaatccgttgaactagaagaacaatttgcacacgagaaactttctccagttcttgctatgtacaaatcaaaatcctttgatgatgcagtaagcaaagctgctcgtcttgttgcagatggcggttatggccatacttcttccatctatattaatgtaggtaccggacaagaaaagattgcaaagttttctgatgctatgaagacttgccgtattcttgtaaatacaccatcctcccatggtggtatcggtgacctttataactttaaattagctccatctcttactcttggttgtggctcctggggcggtaactctgtatcagaaaacgtaggagtaaagcacttaatcaacattaagacagttgctgagaggagagaaaacatgctttggtttagagcacctgagaaagtatactttaagaagggttgtttaccagtagccctcgcagaattaaaagatgtaatgaataaaaagaaagtattcattgtaaccgatgctttcctttataaaaatggctatacaaaatgtgttactgatcagttagatgctatgggaattcagcatactacttactatgatgttgctccagatccatctttagctagtgctacagaaggtgcagaagcgatgagactcttcgagccagactgtattatcgcactcggtggtggttctgcaatggatgccggaaagattatgtgggttatgtatgaacaccctgaagtaaacttccttgaccttgcaatgcgtttcatggatattagaaagcgtgtttactccttccctaagatgggcgaaaaagcttactttatcgcagttccaacttcctccggtactggttctgaagttacaccatttgctgttattaccgatgagagaactggcgtaaaatatccacttgcagattacgaattacttcctaagatggctattattgatgccgatatgatgatgaatcaacctaagggattaacttctgcttccggtattgatgcccttacccatgcattagaggcatatgcttctatcatggctactgactatacggatggtttagcattaaaagctatgaagaatatcttcgcttaccttccaagcgcatatgaaaatggtgccgctgatccggttgcaagagaaaagatggcagatgcttctaccttagctggtatggcattcgcaaatgcattcttaggaatttgccactccatggctcataaattaggtgcattccaccacttaccacacggtgtagcaaacgcactcttaatcaacgaagtaatgcgctttaactccgttagcattcctacaaagatgggtactttctctcaataccaatacccacatgcgttagatcgttatgtagaatgtgcgaacttcttaggtattgccggaaagaacgacaatgagaaattcgaaaaccttcttaaggcaattgatgaattaaaagaaaaagttggtatcaagaaatccatcaaagaatatggcgtagacgagaaatatttcttagatactttagatgctatggttgaacaggctttcgatgatcagtgtactggtgctaacccaagatatccattaatgaaggaaatcaaggaaatctatcttaaagtgtactacggtaaataa

SEQ ID NO: 490 - DNA, 2733 bp, Bifidobacterium adolescentis AADH; identical to SEQ ID NO: 479

SEQ ID NO: 491 - DNA, 2658 bp, Piromyces sp. AADH
atgtccggattacaaatgttccaaaacctttctctttacggtagtctcgccgaaatcgatactagcgaaaagcttaacgaagctatggacaaattaactgctgcccaagaacaattcagagaatacaaccaagaacaagttgacaaaatcttcaaggctgttgctttagctgcttctcaaaaccgtgttgctttcgctaagtacgcacacgaagaaacccaaaagggtgttttcgaagataaggttatcaagaacgaattcgctgctgattacatttaccacaagtactgcaatgacaagaccgccggtatcattgaatatgatgaagccaatggtcttatggaaattgctgaaccagttggtccagttgttggtattgctccagttactaacccaacttctactatcatctacaagtctttaattgccttaaagacccgtaactgtattatcttctcaccacatccaggagctcacaaggcctctgttttcgttgttaaggtcttacaccaagctgctgttaaggctggtgccccagaaaactgtattcaaatcatcttcccaaagatggatttaactactgaattattacaccaccaaaagactcgtttcatttgggctactggtggtccaggtttagttcacgcctcttacacttctggtaagccagctcttggtggtggtccaggtaatgctccagctcttattgatgaaacttgtgatatgaacgaagctgttggttctatcgttgtttctaagactttcgattgtggtatgatctgtgccactgaaaacgctgttgtcgttgtcgaatctgtctacgaaaacttcgttgctaccatgaagaagcgtggtgcctacttcatgactccagaagaaaccaagaaggcttctaaccttcttttcggagaaggtatgagattaaatgctaaggctgttggtcaaactgccaagactttagctgaaatggccggtttcgaagtcccagaaaacaccgttgttctctgtggtgaagcttctgaagttaaattcgaagaaccaatggctcacgaaaagttaactactatcctcggtatctacaaggctaaggactttgacgatggtgtcagattatgtaaggaattagttactttcggtggtaagggtcacactgctgttctctacaccaaccaaaacaacaaggaccgtattgaaaagtaccaaaacgaagttccagccttccacatcttagttgacatgccatcttccctcggttgtattggtgatatgtacaacttccgtcttgctccagctcttaccattacttgtggtactatgggtggtggttcctcctctgataacattggtccaaagcacttacttaacatcaagcgtgttggtatgagacgcgaaaacatgctttggttcaagattccaaagtctgtctacttcaagcgtgctatcctttctgaagctttatctgacttacgtgacacccacaagcgtgctatcattattaccgatagaactatgactatgttaggtcaaactgacaagatcattaaggcttgtgaaggtcatggtatggtctgcactgtctacgataaggttgtcccagatccaactatcaagtgtattatggaaggtgttaatgaaatgaacgtcttcaagccagatttagctattgctcttggtggtggttctgctatggatgccgctaagatgatgcgtttattctacgaatacccagaccaagacttacaagatattgctactcgtttcgtcgatatccgtaagcgtgttgttggttgtccaaagcttggtagacttattaagactcttgtctgtatcccaactacctctggtactggtgccgaagttactccattcgctgtcgttacctctgaagaaggtcgtaagtacccattagtcgactacgaacttactccagatatggctattgttgatccagaattcgctgttggtatgccaaagcgtttaacttcttggactggtattgatgctcttacccacgccattgaatcttacgtttctattatggctactgacttcactagaccatactctctccgtgctgttggtcttatcttcgaatccctttcccttgcttacaacaacggtaaggatattgaagctcgtgaaaagatgcacaatgcttctgctattgctggtatggcctttgccaacgctttccttggttgttgtcactctgttgctcaccaacttggttccgtctaccacattccacacggtcttgccaacgctttaatgctttctcacatcattaagtacaacgctactgactctccagttaagatgggtaccttcccacaatacaagtacccacaagctatgcgtcactacgctgaaattgctgaactcttattaccaccaactcaagttgttaagatgactgatgttgataaggttcaatacttaattgaccgtgttgaacaattaaaggctgacgttggtattccaaagtctattaaggaaactggaatggttactgaagaagacttcttcaacaaggttgaccaagttgctatcatggccttcgatgaccaatgtactggtgctaacccacgttacccattagtttctgaattaaaacaattaatgattgatgcctggaacggtgttgtcccaaagctctaa

SEQ ID NO: 492 - DNA, 2864 bp, Chlamydomonas reinhardtii AADH
tgatgtcctccagcctcgtctctggcaagagggttgccgtgccctctgctgccaagccctgtgctgctgtgccgctgccccgcgtggccggtcgccggactgctgcacgcgttgtctgcgaggctgctccctctggcgccgcccctgccagccccaaggctgaggctgctgcgcccgttgccgctgccccggccaccccccatgctgaggtgaagaaggagcgcgccccagccaccgatgaggcgctgacggagctgaaggcgctgctgaagcgcgcccagaccgcccaggcgcagtactccacctacacccaggagcaggtggacgagatcttccgcgccgccgccgaggccgccaacgccgcccgtatccccctggccaagatggccgtggaggagacccgcatgggcgtggctgaggacaaggtggtgaagaaccacttcgcctccgagttcatctacaacaagtacaagcacactaagacctgcggcgtcatcgagcacgaccccgccggcggcatccagaaggtggctgagcccgtgggcgtcattgccggtatcgtgcccaccaccaaccccacctccaccgccatcttcaagtcgctgctgtcgctcaagacccgcaacgcgctggtgctgtgcccgcacccccgcgccgccaagagcaccatcgccgccgcgcgcatcgtgcgtgacgccgccgtggccgccggcgcgccgcccaacatcatcagctgggtggagacgccctcgctgccggtgtcccaggcgctgatgcaggcgactgagatcaacctcatcctggccaccggtggcccggccatggtgcgcgccgcctactcgtccggcaacccgtcgctgggtgtgggcgccggcaacaccccggccctgattgacgagactgccgacgtggccatggccgtgtcctccatcctgctgtccaagacctttgacaacggcgtcatctgcgcctcggagcagtcggtggtggtggtggccaaggcctacgacgccgtgcgcaccgagttcgtgcgccgcggggcctacttcctgaccgaggacgacaaggtcaaggtccgcgccggtgtggttgtggacggcaagctgaaccccaacattgtgggccagtccatccccaagctggcggccctgttcggcatcaaggtgccccagggcaccaaggtgctcatcggcgaggtggagaagatcggccccgaggaggcgctgtcgcaggagaagctgtgccccatcctggccatgtaccgggcgcccgactacgaccacggcgtcaagatggcctgcgagctcatcatgtacggcggcgccggccacacctcggtgctgtacaccaacccgctcaacaacgcccacatccagcagtaccagagcgcggtcaagaccgtgcgcatcctcatcaacacccccgcctcgcagggcgccattggtgacctgtacaacttccacctggacccctccctcaccctgggctgcggcacctggggctccacctcggtgtccaccaacgtgggcccgcagcacctgctgaacatcaagaccgtcaccgcgcgccgcgagaacatgctgtggttccgcgtgccgcccaagatctacttcaagggcggctgcctggaggtggcgctgaccgatctgcgtggcaaatcgcgcgctttcattgtcacggacaagccgctttttgacatgggatacgccgacaaggtcacccacatcctggacagcattaacgtgcaccaccaggtgttctaccacgtgacccccgacccgaccctggcctgcattgaggcgggtctgaaggagatcctggagttcaagcccgatgtcatcatcgcgctgggtggtggctcgcccatggacgccgccaagatcatgtggctgatgtacgagtgccccgacacccgcttcgacggcctggccatgcgcttcatggacatccgcaagcgcgtgtacgaggtgccggagctgggcaagaaggccaccatggtgtgcatccccaccaccagtggcaccggctcggaggtgacgcccttctcggtggtcaccgacgagcgcctgggcgccaagtaccccctggccgattacgccctgacccccagcatggccattgtggacccccagctggtgctcaacatgcccaagaagctgaccgcctggggcggcattgacgcgctcacgcacgcgctggagagctacgtgtccatctgcgccaccgactacaccaagggtctgtcgcgcgaggccatcagcctgctgttcaagtacctgccccgcgcctacgccaacggctccaacgactacctggcgcgtgagaaggtgcactacgccgccacgattgccggcatggccttcgccaacgccttcctgggcatctgccactccatggcgcacaagctgggcgccgcctaccacgtgcctcacggcctggccaacgccgcgctgatcagccacgtcatccgctacaacgccaccgacatgcccgccaagcaggccgccttcccgcagtacgagtaccccaccgccaagcaggactacgccgacctggccaacatgctgggcctgggcggcaacacggtggacgagaaggtgatcaagctgattgaggcggtggaggagctcaaggccaaggtggacatcccgcccaccatcaaggagatcttcaacgaccccaaggtggacgccgacttcctggcgaacgtggacgccctggccgaggacgccttcgacgaccagtgcacgggcgccaacccgcgctacccgctcatggccgacctgaagcagctctacctggacgcccacgccgcgcccatcctgcccgtcaagaccctggagttcttctccaagatcaactaa

SEQ ID NO: 493 - DNA, 2586 bp, Thermoanaerobacterium saccharolyticum AADH
atgtttattatggcaacgacaaaaacggaattagacgttcagaagcagatagatctacttgtgtcaagagcacaagaggctcagaaaaaattcatgtcttacacgcaagagcaaatcgacgcaatagttaaggcaatggctttagcaggcgttgacaaacacgtagagctggcaaagatggcgtacgaagagacaaaaatgggtgtatacgaagataagataacaaaaaatctcttcgcaacagagtacgtgtaccacgacataaaaaatgaaaagactgtaggaatcataaacgagaacatagaagaaaactacatggaagtggcagaaccgataggcgtaattgccggtgtcacacctgtcacaaacccaacatctaccacgatgtttaaatgcttaatatccataaagacgcgaaatcctataatattcagcttccatccaaaggcaataaagtgcagcatcgcagcagccaaagtgatgtatgaagctgcactaaaggcaggcgcacctgaaggatgcataggatggatagaaacgccatcaattgaggccacacagcttctcatgacacatccaggcgtatcgctgatccttgcaacgggcggtgcaggaatggtaaaagcggcatacagctcaggaaaaccggcattaggcgtaggtcctggcaatgtgccatgctacatcgaaaaatcagcaaacataaagagggctgtatcggatctcatactaagcaagacatttgacaatggagtaatatgcgcatcagagcaggccgtaataatagacgaggaaatagcagatgaagtcaaaaagcttatgaaagaatacggctgctacttcttaaacaaagatgaaataaagaagcttgagaaatttgcaattgatgagcaaagctgcgccatgagccctgcagtggtaggtcagccagcggcgaagattgctgaaatggcaggcttcaaagtccccgaaggcacaaagatattagtggcagagtacgaaggagtaggtccaaaatatcctctatcaagggagaaactaagcccgattcttgcttgctacaccgtcaaagactacaatgaaggaatcaaaaagtgcgaggaaatgactgaattcggaggtttaggccactctgctgtaatacactctgaaaatcaaaacgtcataaatgaatttgcaaggcgagtccgcacaggaagacttatcgtaaattcaccatcatcacagggagcaataggagatatatacaatacaaacacgccatcacttacattaggctgtggttctatgggaagaaactcaacgacagacaatgtaagcgtcaagaaccttttgaatattaagcgtgtcgtgataaggaatgatagaatgaaatggttcaagattccaccgaagatttactttgaaagcgggtcactccagtacctgtgcaaagtcaaaagaaaaaaagcgtttatcgtcacagatccattcatggttaagcttggcttcgtagacaaagtgacatatcaattagacaaagcaaacatcgaatacgaaatattctcagaagtagagccagatccatctgttgacacagtcatgaacggcgtaaaaataatgaattcgtacaatcctgacttaataatcgctgtaggcggtggctctgcaatagacgcagcaaagggaatgtggcttttctacgaatatcctgatacagagtttgaaacattgaggcttaaatttgcagacatcagaaaaagggcatttaagttcccagaacttggcaaaaaagcgctattcatcgcaataccgacaacaagcggcacaggctcagaagtgacagcatttgccgtaataaccgacaaaaagagaaacatcaagtatccactggcagactacgaacttacacctgacatagccataatagatcctgaccttacaaagactgtaccgccatctgtaacagcagacacaggcatggatgtgctgacacacgccatagaagcatacgtatcagtaatggcatcagactacacagatgcactggcggaaaaggctataaagatcgtatttgaatacctgccaagggcttataaaaacggcaatgatgaagaagcccgcgaaaagatgcacaatgcttcctgcatggctggtatggcattcacaaatgcattcttaggaataaaccacagcatggcacacatactgggcggaaagttccacataccacacggaagagcaaatgcaatacttctgccgtatgtaataaggtacaatgcagaaaaacctacaaagtttgtggcattcccacaatacgaatatccaaaagcagcagaaagatatgcggaaatcgccaaattcttaggactgcctgcttcaactgttgaagaaggcgtagaaagcttaatagaagctataaagaacctcatgaaagagcttaacattccgcttacacttaaagacgccggcatcaacaaagaacagtttgaaaaagaaatagaggaaatgtcagacatcgccttcaacgatcagtgcacagggacaaacccgagaatgcctctcacaaaagaaattgcagagatctacagaaaagcatacggtgca

SEQ ID NO: 494 - DNA, 1548 bp, Clostridium phytofermentans ADH alcohol dehydrogenase
atggaaaactttgattttgatttacgttccatccaagaagcaagggatttagcaagaagcggtgaagctgctgctaagaagattgctcagtttagtgaagaacagatagatcgtattcttaagagtatggctaaggcaggagaggaacatgccctatgcttaggagaaatggcttctgaggaaactggatttggaaaggctatggataaggcatataagaaccacgctgcttctacccttttatatgaagagataaaggatatgaagactagaggaatcctagctgaggataccgtaaataagactattgatgtagctgagccggttggtttggtaatgggaatcgttccttctacaaaccctacctcaaccgtattctttaaatccatggttgcagtaaaatcaggaaatgctattgtattttctcctcacccttccgcagcaaaatgtacattaaaggcagctgaaattatgcgcgacgctgcaatcgctgcaggcgcaccagaaggaatcatcggttgtgtgaccatgccttccatgggatctaccaatgaacttatgaagtgtaaggaagtttccgttattatcgcaactggaggtccagctatggtaaaggctgcttatagtgcaggaaagccagctatcggtgtaggtgcaggtaactctcctgcttacattgagaagacagcagatgtaaaacaagcagttaaaacaatcattgccagcaagacatttgactatggtactatctgtgcatccgagcagtccatcatctgcgaggaaagcaatgaagcagaagtattagctgaattaaagagtcagggcggatacttcatgacaaaagaagaaaccgataaggtttgtggcttgttattcaagaacggatacactatgaacgctaaatttgtaggtcgttcccctcaggtgattgctcaggcagctggaattgaaattccgatggataccaaggttcttatcggaagacaggaaggcgtaggtcaaggctatccattatcctttgaaaagcttacaacagttcttggcttctataccgtaaaggactgccatgaggcttgcgatttaagcattcgtcttttacagaacggaatcggacataccatgagtattcacactcaggatagagatatggttcttaagtttgctgcaaagccagcttccagaattcttgttaacacaggcggtagccagggcggaactggaatcagcacaggtcttccaatttcctttacattaggatgcggtacttgcggcggaagttctgtttctgaaaacgtgagtccaaaacatctccttaatgttaagaaggtagcctttggcttaaaggattgttctactatcgcagcagatgatgaaactttcacatggaaggaaaaagcaggaactaattcctgtagtccagcagattttgttgcttcctttgtaaagaaagaaggtactacagctaattcctgtcagggaagctgtgatgataacgagaagctagcagcacttgttaaggaaattgtgttggccatgaaaggtcagtag

SEQ ID NO: 495 - DNA, 1488 bp, Clostridium phytofermentans ADH alcohol dehydrogenase
atggagttacaagagaaagatttaatgtcaatacaagaagtccgtttgcttttaaaaacagcaaaggaagcccataagatattatcaaccttcaatcaagaacaaatcgatcgtattgtaaaggcaattacagaagcatgtttaaagaatgcagagcggcttgctaagatggcaaatgaagaaacaggatttggtatctggcaagataaagtaataaaaaatgtgtttggttctatgggaatctacgaagcaataaaggatatgaaaacaatcggtattcttcgcgaggataagaaaaatcaaacgatggagattggtataccggtaggtattgtagcaggtgttataccttccactaatccaacttctactgttatgtataaaactttaatttcaattaaagcaggtaactgtatcgtattctcgccacatcctggtgcaaaaaaatgtatcttggaaacagttaaggttatttgtgaggctgcagaagcagcaggatgtccaaaaggagccatatcctgtatttccattccaacccttgaggcaacgaatgagttgatgaaacatccaaatacaaatcttatcttagcgaccggtggctatgcaatggtgaaatctgcatactcatccggtacacctgcaataggtgttggtgctggtaatggaccagcattcatcgacaaaacagcaaatgtgaaattagcagtaaagcgtattatggattccaaaacatttgacaatggaaccatttgtgcatcggagcaatctgtaattgtggaacgatgtatggaacaggcggtaaaagaagaactaactgctcaaggcggatttttcttaaatgaggcagagtcagaaaaattagcacgttttatcttacgtgccaatggaacaatgaatccacaaatcgttggaagatcggtagctcatattagtaagcttgccggtttaacaacagtaccagcaaatgcaagagttttaattgcaaaggaaacaagagtcggcgatgaagctccatattccagagagaaattagctccaatcttagcattctttgtagaagaaacggttgatgatgtcattaataaagtggtagagatactaagttttgaaggaatgggacatacctttaccatgcactctaccaatgaagaattgatcaaacgatttgccttacgtgtaccagcttccagaatcttagttaattcaatgggttcactaggtggcgttggagcctctacaaatctattccctgcattaactcttggctgtggagccgtaggaggaagttcttcatctaataatattggtcctatggacttaattaatataaaacgagtagcatttggagtaaaagaattagaagaaattaaaagggatgctacgaatagcctaggtgaaaccaaatcctcttgttgtggtgcatacggtaatgtgaatacagaattggtagaggaaattgtaaaaagaattatgaaacaactaatataa

SEQ ID NO: 496 - protein, 477 aa, Bacillus subtilis amyE Alpha amylase
MFAKRFKTSLLPLFAGFLLLFYLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTFDYAAISNEVKSIPNWTHGNTQIKNWSDRWDVTQNSLLGLYDWNTQNTQVQSYLKRFLERALNDGADGFRFDAAKHIELPDDGSYGSQFWPNITNTSAEFQYGEILQDSASRDAAYANYMDVTASNYGHSIRSALKNRNLGVSNISHYAYDVSADKLVTWVESHDTYANDDEESTWMSDDDIRLGWAVIASRSGSTPLFFSRPEGGGNGVRFPGKSQIGDRGSALFEDQSITAVNRFHNVMAGQPEELSNPNGNNQIFMNQRGSHGVVLANAGSSSVSINTPTKLPDGRYDNKAGAGSFQVNDGKLTGTINARSVAVLYPDDIEIRCNTFFQ

SEQ ID NO: 497 - DNA, 1434 bp, Bacillus subtilis amyE Alpha amylase
atgtttgcaaaacgattcaaaacctctttactgccgttattcgctggatttttattgctgttttatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccacctttgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggcattgaatgacggggcagacggttttcgatttgatgccgccaaacatatagagcttccggatgatgggagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatatgatgtgtctgcggacaagctggtgacatgggtggagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcagtctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtttctatcaatacgccaacaaaattgcctgatggcaggtatgacaataaagctggagcgggttcatttcaagtgaacgatggtaaactgacaggcacgatcaatgccaggtctgtagctgtgctttatcctgatgatattgaaatcaggtgtaacacattctttcaatga

SEQ ID NO: 498 - protein, 659 aa, Bacillus subtilis amyE Alpha amylase
MFAKRFKTSLLPLFAGFLLLFHLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 499 - DNA, 1980 bp, Bacillus subtilis amyE Alpha-amylase
atgtttgcaaaacgattcaaaacctctttactgccgttattcgctggatttttattgctgtttcatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagacagggcattgaatgacggggcagacggttttcgatttgatgccgccaaacatatagagcttccagatgatggcagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgaggttcccggggaaaagccaaataggcgatcgcgggagtgctttatttgaagatcaggctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtctctatcaatacggcaacaaaattgcctgatggcaggtatgacaataaagctggagcgggttcatttcaagtgaacgatggtaaactgacaggcacgatcaatgccaggtctgtagctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacggcgtttaaggatggagatcaattcacaatcggaaaaggagatccatttggcaaaacatacaccatcatgttaaaaggaacgaacagtgatggtgtaacgaggaccgagaaatacagttttgttaaaagagatccagcgtcggccaaaaccatcggctatcaaaatccgaatcattggagccaggtaaatgcttatatctataaacatgatgggagccgagtaattgaattgaccggatcttggcctggaaaaccaatgactaaaaatgcagacggaatttacacgctgacgctgcctgcggacacggatacaaccaacgcaaaagtgatttttaataatggcagcgcccaagtgcccggtcagaatcagcctggctttgattacgtgctaaatggtttatataatgactcgggcttaagcggttctcttccccattga

SEQ ID NO: 500 - protein, 639 aa, Aspergillus niger glaA Glucoamylase
MSFRSLLALSGLVCTGLANVISKRATWDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEVNGSSFFTIAVQHRALVEGSAFATAVGSSCSWCDSQAPEILCYLQSFWTGSFILANFDSSRSAKDANTLLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDATGTYSSSSSTYSSIVDAVKTFADGFVSIVETHAASNGSMSEQYDKSDGEQLSARDLTWSYAALLTANNRRNVVPSASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 501 - DNA, 1920 bp, Aspergillus niger glaA Glucoamylase
atgtcgttccgatctctactcgccctgagcggcctcgtctgcacagggttggcaaatgtgatttccaagcgcgcgacctgggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcaatggctgcttgacaatggctacaccagcaccgcaacggacattgtttggcccctcgttaggaacgacctgtcgtatgtggctcaatactggaaccagacaggatatgatctctgggaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccgccaaggacgcaaacaccctcctgctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaacgtcgtgccttccgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtag

SEQ ID NO: 502 - protein, 985 aa, Aspergillus niger aglA Alpha-glucosidase
MVKLTHLLARAWLVPLAYGASQSLLSTTAPSQPQFTIPASADVGAQLIANIDDPQAADAQSVCPGYKASKVQHNSRGFTASLQLAGRPCNVYGTDVESLTLSVEYQDSDRLNIQILPTHVDSTNASWYFLSENLVPRPKASLNASVSQSDLFVSWSNEPSFNFKVIRKATGDALFSTEGTVLVYENQFIEFVTALPEEYNLYGLGEHITQFRLQRNANLTIYPSDDGTPIDQNLYGQHPFYLDTRYYKGDRQNGSYIPVKSSEADASQDYISLSHGVFLRNSHGLEILLRSQKLIWRTLGGGIDLTFYSGPAPADVTRQYLTSTVGLPAMQQYNTLGFHQCRWGYNNWSDLADVVANFEKFEIPLEYIWTDIDYMHGYRNFDNDQHRFSYSEGDEFLSKLHESGRYYVPIVDAALYIPNPENASDAYATYDRGAADDVFLKNPDGSLYIGAVWPGYTVFPDWHHPKAVDFWANELVIWSKKVAFDGVWYDMSEVSSFCVGSCGTGNLTLNPAHPSFLLPGEPGDIIYDYPEAFNITNATEAASASAGASSQAAATATTTSTSVSYLRTTPTPGVRNVEHPPYVINHDQEGHDLSVHAVSPNATHVDGVEEYDVHGLYGHQGLNATYQGLLEVWSHKRRPFIIGRSTFAGSGKWAGHWGGDNYSKWWSMYYSISQALSFSLFGIPMFGADTCGFNGNSDEELCNRWMQLSAFFPFYRNHNELSTIPQEPYRWASVIEATKSAMRIRYAILPYFYTLFDLAHTTGSTVMRALSWEFPNDPTLAAVETQFMVGPAIMVVPVLEPLVNTVKGVFPGVGHGEVWYDWYTQAAVDAKPGVNTTISAPLGHIPVYVRGGNILPMQEPALTTREARQTPWALLAALGSNGTASGQLYLDDGESIYPNATLHVDFTASRSSLRSSAQGRWKERNPLANVTVLGVNKEPSAVTLNGQAVFPGSVTYNSTSQVLFVGGLQNLTKGGAWAENWVLEW

SEQ ID NO: 503 - DNA, 2958 bp, Aspergillus niger aglA Alpha-glucosidase
atggtgaagttgacgcatctccttgccagagcatggcttgtccctctggcttatggagcgagccagtcactcttatccaccactgccccttcgcagccgcagtttaccattcctgcttccgcagatgtcggtgcgcagctgattgccaacatcgatgatcctcaggctgccgacgcgcagtcggtttgtccgggctacaaggcttcaaaagtgcagcacaattcacgtggattcactgccagtcttcagctcgcgggcaggccatgtaacgtatacggcacagatgttgagtccttgacactgtctgtggagtaccaggattcggatcgactgaatattcagattctccccactcatgttgactccacaaacgcttcttggtactttctttcggaaaacctggtccccagacccaaggcttccctcaatgcatctgtatcccagagcgacctttttgtgtcatggtcaaatgagccgtcgttcaatttcaaggtgatccgaaaggctacaggcgacgcgcttttcagtacagaaggcactgtgctcgtatatgagaatcagttcatcgaatttgtgaccgcgctccctgaagaatataacttgtatggccttggggagcatatcacgcaattccgcctccagagaaatgctaatctgaccatatatccttcggatgatggaacacctattgaccaaaacctctacggccaacatcccttctatctggatacaagatattacaaaggagataggcagaatgggtcttatattcccgtcaaaagcagcgaggctgatgcctcgcaagattatatctccctctctcatggcgtgtttctgaggaactctcatggacttgagatactcctccggtctcaaaaattgatctggcggaccctaggtggaggaatcgatctcaccttctactcaggccccgccccggccgatgttaccaggcaatatcttaccagcactgtgggattaccggccatgcagcaatacaacactcttggattccaccaatgtcgttggggctacaacaactggtcggatctggcggacgttgttgcgaactttgagaagtttgagatcccgttggaatatatctggaccgatattgactacatgcacggatatcgcaactttgacaacgatcaacatcgcttttcctacagtgagggcgatgaatttctcagcaagctacatgagagtggacgctactatgtacccattgttgatgcggcgctctacattcctaatcccgaaaatgcctctgatgcatacgctacgtatgacagaggagctgcggacgacgtcttcctcaagaatcccgatggtagcctctatattggagccgtttggccaggatatacagtcttccccgattggcatcatcccaaggcagttgacttctgggctaacgagcttgttatctggtcgaagaaagtggcgttcgatggtgtgtggtacgacatgtctgaagtttcatccttctgtgtcgggagctgtggcacaggtaacctgactctgaacccggcacacccatcgtttcttctccccggtgagcctggtgatatcatatatgattacccagaggctttcaatatcaccaacgctacagaggcggcgtcagcttcggcgggagcttccagtcaggctgcagcaaccgcgaccaccacgtcgacttcggtatcatatctgcggacaacgcccacgcctggtgtccgcaatgttgagcacccaccctatgtgatcaaccatgaccaagaaggccatgatctcagtgtccatgcggtgtcgccgaatgcaacgcatgttgatggtgttgaggagtatgatgtgcacggtctctacggacatcaaggattgaacgctacctaccaaggtctgcttgaggtctggtctcataagcggcggccatttattattggccgctcaaccttcgctggctctggcaaatgggcaggccactggggcggcgacaactattccaaatggtggtccatgtactactccatctcgcaagccctctccttctcacttttcggcattccgatgtttggtgcggacacctgtgggtttaacggaaactccgatgaggagctctgcaaccgatggatgcaactgtccgcattcttcccattctaccgaaaccacaatgagctctccacaatcccacaggagccttatcggtgggcttctgttattgaagcaaccaagtccgccatgagaattcggtacgccatcctaccttacttttatacgttgtttgacctggcccacaccacgggctccactgtaatgcgcgcactttcctgggaattccctaatgacccaacattggctgcggttgagactcaattcatggttgggccggccatcatggtggtcccggtattggagcctctggtcaatacggtcaagggcgtattcccaggagttggacatggcgaagtgtggtacgattggtacacccaggctgcagttgatgcgaagcccggggtcaacacgaccatttcggcaccattgggccacatcccagtttatgtacgaggtggaaacatcttgccgatgcaagagccggcattgaccactcgtgaagcccggcaaaccccgtgggctttgctagctgcactaggaagcaatggaaccgcgtcggggcagctctatctcgatgatggagagagcatctaccccaatgccaccctccatgtggacttcacggcatcgcggtcaagcctgcgctcgtcggctcaaggaagatggaaagagaggaacccgcttgctaatgtgacggtgctcggagtgaacaaggagccctctgcggtgaccctgaatggacaggccgtatttcccgggtctgtcacgtacaattctacgtcccaggttctctttgttggggggctgcaaaacttgacgaagggcggcgcatgggcggaaaactgggtattggaatggtag

SEQ ID NO: 504 - protein, 512 aa, Bacillus licheniformis Alpha amylase
MKQQKRLYARLLTLLFALIFLLPHSAAAAANLNGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHLIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNGTVVSKHPLKSVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 505 - DNA, 1539 bp, Bacillus licheniformis Alpha amylase
atgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgtttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacacctaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaatcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatag

SEQ ID NO: 506 - protein, 860 aa, Aspergillus niger bgl1 beta glucosidase; identical to SEQ ID NO: 451

SEQ ID NO: 507 - DNA, 2583 bp, Aspergillus niger bgl1 beta glucosidase; identical to SEQ ID NO: 480

SEQ ID NO: 508 - DNA, 11089 bp, Artificial
  pMU2115
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacggcggccgcgacggttgaaagtggacagaggaaaaggtgcggaaatggctgattttgattgtttatgttttgtgtgatgattttacatttttgcatagtattaggtagtcagatgaaagatgaatagacataggagtaagaaaacatagaatagttaccgttattggtaggagtgtggtggggtggtatagtccgcattgggatgttactttcctgttatggcatggatttccctttagggtctctgaagcgtatttccgtcaccgaaaaaggcagaaaaagggaaactgaagggaggatagtagtaaagtttgaatggtggtagtgtaatgtatgatatccgttggttttggtttcggttgtgaaaagttttttggtatgatattttgcaagtagcatatatttcttgtgtgagaaaggtatattttgtatgttttgtatgttcccgcgcgtttccgtattttccgcttccgcttccgcagtaaaaaatagtgaggaactgggttacccgtttaaactaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatgaggcgcgccattgaattgaattgaaatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgtttcgaaagggctcttcattgagcttagaacccttttgggcagaaagatatccgtcgaacaacgttctattaggaatggcggataaattatttaaattatatcacactaattttcctcctgtggtagccctaagaacttttggtttgaatctgacgaataagatcggtccagttaagaatatgatcattgacacattaggaggaaatgagaaatgagaggtatgtaaatagaaatagactagctccacttttaagaattatttatgcaattaaatacatgggtgaccaaaagagcgggcggatacacgcgtcaccacaagcagaataaaaggtaaacctgaaattgttttaacataaaatgaaaaatgcttgtttgcaaccctatatagaatcataaaacattcgtgactataaaatgaataaactaaactattctaagaaaatgaaataaatgacaaaaaaacgtgttttttggactagaaggcttaatcaaaagctctcgagggcgcggcgcgccttagaatggtggatttgcgttcgttaacaattgttcaaaataagcctggaaccattgtccagcctcgggggcgggctgtaaagcgtcggacagaccacagtggtaatcgtatcttgcagcactcgtgtcacttgttccgtcactttcgccacctggcttaacccatacaaaagcgtcgactagctcgtgtccggtgtttgccgtaggcctgacgccgaagccggttcccttgacgttacaccaatctccccattgttgttgtccagttggttgtttgccgtttctaccggtatccacgatgaatctggcagggaatccagcggagtttaacaatggggaaaatgcttctatgtaatgtttctcatcgtagttaggatttggtgaggtataagaaggggcactagcaattgaccaagcgttgtaatttgcaacatttgtggctaagcctctaacggcagcgggctttccggcgtcgttgtagattccagcgaacaattcagctgcgggttggatatttgcaggccagcccaaccatccggcatgaccggcatctaagtacatagcaacgttaggtagattcagttgttttaatgcatatacggttagctcatggtatgtggaagctgcgttagaacacttggctacattcatgttggtaaccatattagccatggagtctggttcaatcacaaggattattctaatatcagaatactcaatgatgtgttttcttattgcatcaatgtatgatctatagtttgcagctccgccatttgcgatggaaaattcaccattagaagctgcggcagcacagtctctatctggcaagtcatagactactaattgggcagcataaggtgggttggcaccggccttattcaaagctctaacctgagataaagtctgtaccataagtgtatctattgtaacgtttctgtcaagccattggaaactagggacttctgctacggcggaagcctttgcggctagggttcccgtcatagaaggaattgcaaggttgtgaacctctgatctataatagtcgtttgcaaataatctcactccagagaaaggattgccggaataactggctgttgaggttgctccgccagggatactcgtgacaggacttgatacgggtggaggggtcgtactgctagatgaggatgagccacttctggttgtgctagaagaggtacttgtggatctctgtgaagtagacgttgagctgggggttgttgaagaagtcacctgggagtttggaaggcactgggaataccactcgttctgtgccacgcacgttgagccagaagcacaacatgttgggccttgccagccgttgcctccgcactgtgtccagacggctccgcaattttgtctctcttcgatcactggtgcagcaagcactgcggcagctaaggcagcggtaatgaacaacttcttggccattgtttaattaagttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattgtgcagatgttataatatctgtgcgtcttgagttgaagtcaggaatctaaaataaaaattaaggttaataaaaagaggaaagaaaaaaaaattaatcgatttacagaaacttgcacactaaaaatacacaactaaaagcaattacagtatgggaagtcatcgacgttatctctactatagtatattatcatttctattattatcctgctcagtggtacttgcaaaacaagatgagaccccattctttgaaggtacttcttcgaaaaattcgcgtctaactgcacaagataagggcaatgatacgtgcccgccatgttttaattgtatgctacctatttttgaatgcaaacagttttctgaatgcaattcgtacactggtagatgtgagtgtatagaagggtttgcaggtgatgattgctctctgcccctctgtggcggtctatcaccggatgaaagcggtaataaggatcgtcccataagagcacaaaatgacacctgtcattgtgataacggatggggagggatcaattgtgacgtttgtcaagaagattttgtctgtgatgcgttcatgcctgatcctagtattaaggggacatgttataagaatggtatgattgtagataaagtattttcaggttgtaatgtgaccaatgagaaaattctacagattttgaacggcaaaataccacaaattacatttgcctgtgataaacctaatcaagaatgtaattttcagttttggatagatcagttagaaagcttcagttttggatagatcagttagaaagcttgagtaggcttgtcgttcgttatgtttttgtaaatggcctcgtcaaacggtggagagagtcgctaggtgatcgtcagatctgcctagtctctatacagcgtgtttaattgacatgggttgatgcgtattgagagatacaatttgggaagaaattcccagagtgtgtttcttttgcgtttaacctgaacagtctcatcgtgggcatcttgcgattccattggtgagcagcgaaggatttggtggattactagctaatagcaatctatttcaaagaattcaaacttgggggaatgccttgttgaatagccggtcgcaagactgtgattcttcaagtgtaacctcctctcaaatcagcgatatcaaacgtaccattccgtgaaacaccggggtatctgtttggtggaacctgattagaggaaactcaaagagtgctatggtatggtgacggagtgcgctggtcaagagtgtaaaagctttttgaacagagagcatttccggcagcagagagagcggccgcgctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 509 - DNA, 11046 bp, Artificial
  pMU2143
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcgcggccgctgttggaacgagagtaattaatagtgacatgagttgctatggtaacaattcaatgcttacatcgtatattaatgtacaactcgtatacgtttaagtgtgattgcgcctattgcagaaggaatgttaaacgagaagctcagacaatactgaagctgtgttaaagacctattagttgaacatgttatgttcgaagaaggatgttattatatgatctctgatggcgaaatggcagtactcgggggaatgctctcatgtgtaccttttgattggaattggttcgcagtgtttatgttatattagctcaatgtgctccctgtattttatatatgaaacaagtctttgtattgctatttttttcaaacctttttctcaactctaaaagcggtccacgttagttttctttggatatagcagttgttgtacactagcttaagatgtaaaattcaattcaatatgattttgtgtgggatgttttaaagaaggcacaagcctgttctctctttttctcttttttcatggattgtatcgcttaaaagggagaaatgaagtaaacgattctttttgtaaaaatataaaaccaaattttttaatttatatgtatacatatttatttatgacgtaagaccaagtaagtttatatgaaagtattttgtgtatatgacggaaagaaatgcaggttggtacattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacccggcggggacgaggcaagctaaacagatctctagacctaggctcttcattgagcttagaacccttttgggcagaaagatatccgtcgaacaacgttctattaggaatggcggataaattatttaaattatatcacactaattttcctcctgtggtagccctaagaacttttggtttgaatctgacgaataagatcggtccagttaagaatatgatcattgacacattaggaggaaatgagaaatgagaggtatgtaaatagaaatagactagctccacttttaagaattatttatgcaattaaatacatgggtgaccaaaagagcgggcggatacacgcgtcaccacaagcagaataaaaggtaaacctgaaattgttttaacataaaatgaaaaatgcttgtttgcaaccctatatagaatcataaaacattcgtgactataaaatgaataaactaaactattctaagaaaatgaaataaatgacaaaaaaacgtgttttttggactagaaggcttaatcaaaagctctcgagggcgcggcgcgccttagaatggtggatttgcgttcgttaacaattgttcaaaataagcctggaaccattgtccagcctcgggggcgggctgtaaagcgtcggacagaccacagtggtaatcgtatcttgcagcactcgtgtcacttgttccgtcactttcgccacctggcttaacccatacaaaagcgtcgactagctcgtgtccggtgtttgccgtaggcctgacgccgaagccggttcccttgacgttacaccaatctccccattgttgttgtccagttggttgtttgccgtttctaccggtatccacgatgaatctggcagggaatccagcggagtttaacaatggggaaaatgcttctatgtaatgtttctcatcgtagttaggatttggtgaggtataagaaggggcactagcaattgaccaagcgttgtaatttgcaacatttgtggctaagcctctaacggcagcgggctttccggcgtcgttgtagattccagcgaacaattcagctgcgggttggatatttgcaggccagcccaaccatccggcatgaccggcatctaagtacatagcaacgttaggtagattcagttgttttaatgcatatacggttagctcatggtatgtggaagctgcgttagaacacttggctacattcatgttggtaaccatattagccatggagtctggttcaatcacaaggattattctaatatcagaatactcaatgatgtgttttcttattgcatcaatgtatgatctatagtttgcagctccgccatttgcgatggaaaattcaccattagaagctgcggcagcacagtctctatctggcaagtcatagactactaattgggcagcataaggtgggttggcaccggccttattcaaagctctaacctgagataaagtctgtaccataagtgtatctattgtaacgtttctgtcaagccattggaaactagggacttctgctacggcggaagcctttgcggctagggttcccgtcatagaaggaattgcaaggttgtgaacctctgatctataatagtcgtttgcaaataatctcactccagagaaaggattgccggaataactggctgttgaggttgctccgccagggatactcgtgacaggacttgatacgggtggaggggtcgtactgctagatgaggatgagccacttctggttgtgctagaagaggtacttgtggatctctgtgaagtagacgttgagctgggggttgttgaagaagtcacctgggagtttggaaggcactgggaataccactcgttctgtgccacgcacgttgagccagaagcacaacatgttgggccttgccagccgttgcctccgcactgtgtccagacggctccgcaattttgtctctcttcgatcactggtgcagcaagcactgcggcagctaaggcagcggtaatgaacaacttcttggccattgtttaattaagttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattgtgcagatgttataatatctgtgcgtcttgagttgaagtcaggaatctaaaataaaaattaaggttaataaaaagaggaaagaaaaaaaaattaatcgatttacagaaacttgcacactaaaaatacacaactaaaagcaattacagtatgggaagtcatcgacgttatctctactatagtatattatcatttctattattatcctgctcagtggtacttgcaaaacaagatgagaccccattctttgaaggtacttcttcgaaaaattcgcgtctaactgcacaagataagggcaatgatacgtgcccgccatgttttaattgtatgctacctatttttgaatgcaaacagttttctgaatgcaattcgtacactggtagatgtgagtgtatagaagggtttgcaggtgatgattgctctctgcccctctgtggcggtctatcaccggatgaaagcggtaataaggatcgtcccataagagcacaaaatgacacctgtcattgtgataacggatggggagggatcaattgtgacgtttgtcaagaagattttgtctgtgatgcgttcatgcctgatcctagtattaaggggacatgttataagaatggtatgattgtagataaagtattttcaggttgtaatgtgaccaatgagaaaattctacagattttgaacggcaaaataccacaaattacatttgcctgtgataaacctaatcaagaatgtaattttcagttttggatagatcagttagaaagcttggtaggtacatatatgaggaatatgagtcgtcacatcaatgtatagtaactaccggaatcactattatattggtcatgattaatatgaccaatcggcgtgtgttttatatacctctcttatttagtataagaagatcagtaattatttcttcattaatactaatttttaacctctaattatcaacagcggccgctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 510 - DNA, 11375 bp, Artificial
  pMU2142
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcgcggccgccaagtgaaagtacacgcaaatatccttatcctttcattcatcgaatgcttgcgcatgccaatgcacagacaaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacgtcgacaactaaactggaatgtgagggaacaacaaaagtcctttacgcatattttgtcccaaaagaaccaagaaaaatatgcacatgaggcgaacaaagtcagaaatcaagcagaacctttagaggtaataagagataaatactctctggaagcagacgctactaaggaaaacaacaacggaagcgatgatgagagcgacgatgagagtgtaaactgcgaagcttgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgatatcgacaaaggaaaaggggcctgtttattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttacccatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacccggcggggacaaggcaagctggctcttcattgagcttagaacccttttgggcagaaagatatccgtcgaacaacgttctattaggaatggcggataaattatttaaattatatcacactaattttcctcctgtggtagccctaagaacttttggtttgaatctgacgaataagatcggtccagttaagaatatgatcattgacacattaggaggaaatgagaaatgagaggtatgtaaatagaaatagactagctccacttttaagaattatttatgcaattaaatacatgggtgaccaaaagagcgggcggatacacgcgtcaccacaagcagaataaaaggtaaacctgaaattgttttaacataaaatgaaaaatgcttgtttgcaaccctatatagaatcataaaacattcgtgactataaaatgaataaactaaactattctaagaaaatgaaataaatgacaaaaaaacgtgttttttggactagaaggcttaatcaaaagctctcgagggcgcggcgcgccttagaatggtggatttgcgttcgttaacaattgttcaaaataagcctggaaccattgtccagcctcgggggcgggctgtaaagcgtcggacagaccacagtggtaatcgtatcttgcagcactcgtgtcacttgttccgtcactttcgccacctggcttaacccatacaaaagcgtcgactagctcgtgtccggtgtttgccgtaggcctgacgccgaagccggttcccttgacgttacaccaatctccccattgttgttgtccagttggttgtttgccgtttctaccggtatccacgatgaatctggcagggaatccagcggagtttaacaatggggaaaatgcttctatgtaatgtttctcatcgtagttaggatttggtgaggtataagaaggggcactagcaattgaccaagcgttgtaatttgcaacatttgtggctaagcctctaacggcagcgggctttccggcgtcgttgtagattccagcgaacaattcagctgcgggttggatatttgcaggccagcccaaccatccggcatgaccggcatctaagtacatagcaacgttaggtagattcagttgttttaatgcatatacggttagctcatggtatgtggaagctgcgttagaacacttggctacattcatgttggtaaccatattagccatggagtctggttcaatcacaaggattattctaatatcagaatactcaatgatgtgttttcttattgcatcaatgtatgatctatagtttgcagctccgccatttgcgatggaaaattcaccattagaagctgcggcagcacagtctctatctggcaagtcatagactactaattgggcagcataaggtgggttggcaccggccttattcaaagctctaacctgagataaagtctgtaccataagtgtatctattgtaacgtttctgtcaagccattggaaactagggacttctgctacggcggaagcctttgcggctagggttcccgtcatagaaggaattgcaaggttgtgaacctctgatctataatagtcgtttgcaaataatctcactccagagaaaggattgccggaataactggctgttgaggttgctccgccagggatactcgtgacaggacttgatacgggtggaggggtcgtactgctagatgaggatgagccacttctggttgtgctagaagaggtacttgtggatctctgtgaagtagacgttgagctgggggttgttgaagaagtcacctgggagtttggaaggcactgggaataccactcgttctgtgccacgcacgttgagccagaagcacaacatgttgggccttgccagccgttgcctccgcactgtgtccagacggctccgcaattttgtctctcttcgatcactggtgcagcaagcactgcggcagctaaggcagcggtaatgaacaacttcttggccattgtttaattaagttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattgtgcagatgttataatatctgtgcgtcttgagttgaagtcaggaatctaaaataaaaattaaggttaataaaaagaggaaagaaaaaaaaattaatcgatttacagaaacttgcacactaaaaatacacaactaaaagcaattacagtatgggaagtcatcgacgttatctctactatagtatattatcatttctattattatcctgctcagtggtacttgcaaaacaagatgagaccccattctttgaaggtacttcttcgaaaaattcgcgtctaactgcacaagataagggcaatgatacgtgcccgccatgttttaattgtatgctacctatttttgaatgcaaacagttttctgaatgcaattcgtacactggtagatgtgagtgtatagaagggtttgcaggtgatgattgctctctgcccctctgtggcggtctatcaccggatgaaagcggtaataaggatcgtcccataagagcacaaaatgacacctgtcattgtgataacggatggggagggatcaattgtgacgtttgtcaagaagattttgtctgtgatgcgttcatgcctgatcctagtattaaggggacatgttataagaatggtatgattgtagataaagtattttcaggttgtaatgtgaccaatgagaaaattctacagattttgaacggcaaaataccacaaattacatttgcctgtgataaacctaatcaagaatgtaattttcagttttggatagatcagttagaaagcttgaaatacacgcgataagtgaatctgtcccattattaaataatctaagttacctgatacaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctggcggccgctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 511 - DNA, 7924 bp, Artificial
  pMU1392
taaaatgttgttgcaagcttttttgtttttgttggctggttttgctgctaaaatttctgctcaacaagctggtactgctactgctgaaaatcatccaccattgacttggcaagaatgtactgctccaggttcttgtactactcaaaatggtgctgttgttttggatgctaattggagatgggttcatgatgttaatggttacactaattgttacactggtaatacttgggatccaacttattgtccagatgatgaaacttgtgctcaaaattgtgctttggatggtgctgattatgaaggtacttatggtgttacttcttctggttcttctttgaaattgaacttcgttactggttctaatgttggttctagattgtatttgttgcaagatgattctacttaccaaattttcaagttgttgaacagagaattttctttcgatgttgatgtttctaatttgccatgtggtttgaatggtgctttgtattttgttgctatggatgctgatggtggtgtttcaaaatatccaaacaacaaagctggtgcaaaatatggtactggttactgtgattctcaatgtccaagagatttgaagtttattgatggtgaagctaatgttgaaggttggcaaccatcttctaacaatgctaatactggtattggtgatcatggttcttgttgtgctgaaatggatgtttgggaagctaattctatttctaatgctgttactccacatccatgtgatactccaggtcaaactatgtgttctggtgatgattgtggtggtacttattctaatgacagatacgctggtacttgtgatccagatggttgtgattttaatccatacagaatgggtaatacttctttttatggtcctggtaagattattgatactactaagccatttactgttgttactcaattcttgactgatgatggtactgatactggtactttgtctgaaattaagagattctacattcaaaactctaacgttattccacaaccaaattctgatatttctggtgttactggtaattctattactactgaattttgtactgctcaaaaacaagcttttggtgatactgatgatttttctcaacatggtggtttggctaaaatgggtgctgctatgcaacaaggtatggttttggttatgtctttgtgggatgattatgctgctcaaatgttgtggttggattctgattatccaactgatgctgatccaactactccaggtattgctagaggtacttgtccaactgattctggtgttccatctgatgttgaatctcaatctccaaattcttacgttacttactctaacattaagttcggtccaattaattctacttttactgctagcttgccaggtgctggtaatggtggtaataacggtggtaacccaccaccaccaaccactaccacttcttctgccccagctactaccaccaccgcttctgctggtccaaaggctggtagatggcaacaatgtggtggtattggtttcaccggtccaacccaatgtgaagaaccatacatctgtaccaagttgaacgactggtactctcaatgtttataaggcgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcggccgcaagctaattcgcgcgaagctagcttggcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaat

SEQ ID NO: 512 - DNA, 8796 bp, Artificial
  pMU1821
aaaaagaatcatgattgaatgaagatattatttttttgaattatattttttaaattttatataaagacatggtttttcttttcaactcaaataaagatttataagttacttaaataacatacattttataaggtattctataaaaagagtattatgttattgttaacctttttgtctccaattgtcgtcataacgatgaggtgttgcatttttggaaacgagattgacatagagtcaaaatttgctaaatttgatccctcccatcgcaagataatcttccctcaaggttatcatgattatcaggatggcgaaaggatacgctaaaaattcaataaaaaattcaatataattttcgtttcccaagaactaacttggaaggttatacatgggtacataaatgcagatgccagtgaactatgttcagcttctggccttcgtttggtggtttaatctattttttataaaaaatgacgcgggcagattcaattagtgtcctaaatccgcggtaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaaatgttgttgcaagcttttttgtttttgttggctggttttgctgctaaaatttctgctcaacaaccagctgcttcttctgctggtaatccaaaattgactacttacaagtgtactactgcaggtggttgtgttgctcaagatacttctgttgttttggattggggttatcattggattcatactgttgatggttatacttcttgtactacttcttctggtgttgattctactttgtgtccagatgctgctacttgtgctaaaaactgtgttattgaaccagctaattatacatctgctggtgttactacttctggtgattctttgacaatgtaccaatacgttcaatctaatggtgtttacactaatgcttctccaagattgtatttgttgggtccagataaaaactacgtcatgttgaagttgttgggtcaagaattgacttttgatgttgatttgtctactttgccatgtggtgaaaatggtgctttgtatttgtctgaaatgtctgctactggtggtagaaatgaatacaatactggtggtgctgaatatggttctggttattgtgatgctcaatgtccagttattgcttggaaaaatggtactttgaatacatctggtgcttcatattgttgtaacgaaatggatattttggaagctaattctagagctaattcttatactccacatccatgttctgctactgattgtgataaaggtggttgtggttttaatccatatgctttgggtcaaaaatcttattggggtccaggtggtactgttgatacttctaagccattcactattactactcaattcattacaaacgatggtactactactggtactttgtcagaaattagaagacaatacatgcaaaacggtaaggttattgctaatgctgtttcttctacaggtgttaactctattactgaagattggtgtacttcagttgatggttctgctgctacttttggtggtttgactactatgggtaaagctttgggtagaggtatggttttgattttctctatttggaatgatgcttctggttttatgaattggttggattctggtaatgctggtccatgttcttctacagaaggtaatccagatttgattaaggctcaaaatccaactactcatgttgttttctcaaatattagatggggtgatattggttctacttttaaaggttctgatggttctgttactactactacttctacaacttctactaagactactacatctactgctccaggtccaactcaaactcattatggtcaatgtggtggtcaaggttggactggtccaactgcttgtgcttctccatatacttgtcaagttttgaatccatggtactctcaatgcttataaggcgcgccc

SEQ ID NO: 513 - DNA, 8045 bp, Artificial
  pMU1479
caggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagtctagtcgtttacgtcaccatcgctgacggggaaaaaacaaaacaagcttcctgaaacggagaaacataaacaggcattgctgggatcacccatacatcactctgttttgcctgaccttttccggtaatttgaaaacaaacccggtctcgaagcggagatccggcgataattaccgcagaaataaacccatacacgagacgtagaaccagccgcacatggccggagaaactcctgcgagaatttcgtaaactcgcgcgcattgcatctgtatttcctaatgcggcacttccaggcctcgagacctctgacatgcttttgacaggaatagacattttcagaatgttatccatatgcctttcgggtttttttccttccttttccatcatgaaaaatctctcgagaccgtttatccattgcttttttgttgtctttttccctcgttcacagaaagtctgaagaagctatagtagaactatgagctttttttgtttctgttttccttttttttttttttacctctgtggaaattgttactctcacactctttagttcgtttgtttgttttgtttattccaattatgaccggtgacgaaacgtggtcgatggtgggtaccgcttatgctcccctccattagtttcgattatataaaaaggccaaatattgtattattttcaaatgtcctatcattatcgtctaacatctaatttctcttaaattttttctctttctttcctataacaccaatagtgaaaatctttttttcttctatatctacaaaaactttttttttctatcaacctcgttgataaattttttctttaacaatcgttaataattaattaattggaaaataaccattttttctctcttttatacacacattcaaaagaaagaaaaaaaatataccccagctagttaaagaaaatcattgaaaagaataagaagataagaaagatttaattatcaaacaatatcaatatgaacaagtctgttgctccattgttgttggctgcttctattttgtatggtggtgctgttgctcaacaaactgtttggggtcaatgtggtggtattggttggtctggtccaactaattgtgctccaggttctgcttgttctactttgaatccatattatgctcaatgtattccaggtgctactactattactacttctactagaccaccatctggtccaacaactactactagagctacttctacatcttcttctactccaccaacttcatctggtgttagatttgctggtgttaacattgctggttttgattttggttgtactactgatggtacttgtgttacttctaaagtttacccaccattgaaaaatttcactggttctaacaattatccagatggtattggtcaaatgcaacattttgttaacgaagatggtatgactatttttagattgccagttggttggcaatatttggttaacaacaatttgggtggtaatttggattctacttctatttctaagtacgatcaattggttcaaggttgtttgtctttgggtgcttactgtattgttgatattcataattatgctagatggaatggtggtattattggtcaaggtggtccaacaaatgctcaatttacttctttgtggtcacaattggcttcaaaatatgcttctcaatctagagtttggtttggtattatgaatgaaccacatgatgttaacattaatacttgggctgctactgttcaagaagttgttactgctattagaaatgctggtgctacttctcaattcatttctttgccaggtaatgattggcaatctgctggtgcttttatttctgatggttctgctgctgctttgtctcaagttactaatccagatggttctactactaatttgatcttcgatgttcataagtacttggattctgataattctggtactcatgctgaatgtactacaaacaatattgatggtgctttttctccattggctacttggttgagacaaaacaatagacaagctattttgactgaaactggtggtggtaatgttcaatcttgtatccaagatatgtgccaacaaattcaatacttgaaccaaaattctgatgtttatttgggttacgttggttggggtgctggttcttttgattctacttacgttttaactgaaactccaacttcttctggtaattcttggactgatacttctttggtttcttcatgtttggctagaaagttataaggcgcgccgcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcggccgcaagctaattcgcgcgaagctagcttggcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatc

SEQ ID NO: 514 - DNA, 8041 bp, Artificial
  pMU1958
cagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactacttattcccttcgagattatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaattaattaaaatgaaaaccttcgctattttgggtgcttttttttcttctgctttggctcaaactttgtgtgatcaatatgctacttactctaatggcagatacactgttaacaacaatttgtggggtaaatcttctggttctggttctcaatgtacttacgttgattctatttctaattctggtgttgcttggcatactacttggacttggtctggtggtgataatcaagttaaatcttacgctaactctcaagtttctttgactaagaagttggtttctcaaatttcttctattccaactactgttcaatggtcttacgataacactaatactagagctgatgttgcttatgatttgtttactgctgctgatattaatcatgttacctactctggtgattatgaattgatgatttggttggcaagatatggttctgttcaaccaattggttctcaaattgattctgttaacattggtggtcatacttgggaattgtggtatggtggttctactcaaaaaacttactctttcgtttctgctactccaattacttctttttctggtgatgttatggatttttgggattacttgacttctagacatggttatccagcttcatctcaatacttgatcaacatgcaatttggtactgaaccatttactggtggtccagctactttgagagtttctcaatggactgcttctgttaactaaggcgcgccgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgt

SEQ ID NO: 515 - DNA, 10264 bp, Artificial
  pMU1975
taaaaacaaaatggtcagcttcacctccttgttggctggtgttgctgctatttctggtgttttggctgctccagctgctgaagttgaaccagttgctgttgaaaagagagaagctgaagccgaagccgaaccagcattcaactacgctgaagctttgcaaaagtctatgttcttctacgaagctcaaagatctggtaagttgccagaaaacaacagagtctcttggagaggtgactccggtttgaacgatggtgccgatgttggtttggacttgaccggtggttggtacgacgctggtgaccatgttaaattcggtttcccaatggctttcactgccactatgttggcttggggtgccatcgaatctccagaaggttacattagaagtggacaaatgccatacttgaaggataacttgagatgggttaacgattacttcatcaaagctcacccatccccaaacgtgttgtacgtccaagttggtgatggtgacgctgaccacaagtggtggggtccagctgaagtcatgccaatggaaagaccatctttcaaggtcgacccatcttgtccaggttctgacgtcgctgctgaaaccgctgctgccatggctgcttcttctattgttttcgctgacgacgacccagcttacgctgccaccttggttcaacacgctaagcaattgtacactttcgccgacacttatagaggtgtttactctgattgtgttccagccggtgctttctataactcttggtctggttatcaagatgaattggtctggggtgcttactggttgtacaaagctactggtgacgactcttacttggctaaggctgaatacgaatacgacttcttgtctactgaacaacaaaccgacttgagatcttacagatggactatcgcttgggatgataagtcttacggtacctacgtcttgttggctaaagaaaccggtaagcaaaagtacatcgatgatgctaacagatggttggattactggaccgtcggtgttaacggtcaaagagtcccatactctccaggtggtatggctgttttggatacctggggtgctttgagatacgctgccaacaccgccttcgttgctttggtttacgctaaggttatcgatgacccagttagaaagcaaagataccacgacttcgctgttcgtcaaatcaactacgctttgggtgacaacccaagaaactcttcctacgttgttggtttcggtaataatccaccaagaaaccctcaccacagaactgctcacggttcctggactgactccattgcttccccagctgaaaacagacatgtcttgtacggtgctttggtcggtggccctggttccccaaacgatgcttacactgatgaccgccaagactacgttgctaacgaagttgccaccgactacaacgctggtttctcttctgctttggctatgttggtcgaagaatacggtggtactccattggctgatttcccaccaaccgaagaaccagatggtccagaaatcttcgttgaagctcaaatcaacaccccaggtaccactttcaccgaaattaaggctatgattcgtaaccaatccggttggcctgccagaatgttggataagggtaccttcagatactggttcactttggacgaaggtgttgacccagccgacattaccgtctcttccgcctacaaccaatgtgctaccccagaagacgttcaccatgtttctggtgacttgtactatgttgaaattgactgtactggtgaaaagatcttcccaggtggtcaatctgaacacagaagagaagtccaattcagaatcgctggtggtccaggttgggacccatccaacgattggtccttccaaggtattggtaacgaattggctccagctccatacattgttttgtacgacgacggtgttccagtctggggtaccgctccagaagaaggtgaagaacctggtggcggtgaaggtccaggtggtggtgaagaaccaggtgaagacgttactccaccatctgctccaggttctccagccgtccgtgacgttacctctacttctgctgttttgacctggtctgcttcttctgacactggtggttctggtgtcgccggttacgacgttttcttgagagctggtaccggtcaagaacaaaaggtcggttccaccactagaacctccttcactttgactggtctagaaccagacactacctatatcgctgccgttgtcgctcgtgacaatgctggtaacgtttctcaaagatctaccgtttccttcactaccttggctgaaaacggtggtggtccagacgcctcttgcaccgtcggttactctactaatgactgggattctggtttcactgcttctattagaatcacctaccacggtactgctcctttgtcctcctgggaattgtccttcaccttcccagctggtcaacaagtcacccacggttggaacgctacttggagacaagacggtgccgctgttactgccaccccaatgtcttggaactcctctttggctccaggtgctaccgtcgaagtcggtttcaatggttcttggtccggttctaacactccaccaaccgacttcaccttgaacggtgaaccatgtgctttggcttaaggcgcgccagtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtgcacacgcgtggctttttcttgaatttgcagtttgaaaaataactacatggatgataagaaaacatggagtacagtcactttgagaaccttcaatcagctggtaacgtcttcgttaattggatactcaaaaaagatggatagcatgaatcacaagatggaaggaaatgcgggccacgaccacagtgatatgcatatgggagatggagatgatacctgttcgatgaatatgctattttcgtggtcatacaagaatacgtgtgtcgtctttgaatggtggcatatcaagaccctgcctggactgattttaagttgttttaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccaaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaattaat

SEQ ID NO: 516 - DNA, 6952 bp, Artificial
  pMU227
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacggatttaggtgacactatagaacgcggccgccagctgaagcttcgtacgctgcaggtcgacaacccttaatataacttcgtataatgtatgctatacgaagttattaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgacggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtggcctatgcggccgcggatctgccggtctccctatagtgagtcgtattagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 517 - DNA, 3704 bp, Artificial
  pMU183
gaacgcggccgccagctgaagcttcgtacgctgcaggtcgacggatccccgggttaattaaggcgcgccagatctgtttagcttgccttgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgacggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcgaattcatcgatgatatcagatccactagtggcctatgcggccgcggatctgccggtctccctatagtgagtcgtattaatttcgataagccaggttaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactata

SEQ ID NO: 518 - DNA, 11998 bp, Artificial
  pMU1260
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacggcggccgctgttggaataaaaatccactatcgtctatcaactaatagttatattatcaatatattatcatatacggtgttaagatgatgacataagttatgagaagctgtcatcgatgttagaggaagctgaaacgcaaggattgataatgtaataggatcaatgaatataaacatctccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacattaattaaaaacaaaatggtctccttcacctccctcctcgccggcgtcgccgccatctcgggcgtcttggccgctcccgccgccgaggtcgaatccgtggctgtggagaagcgctcgcgagtcccaattcaaaactatacccagtctccatcccagagagatgagagctcccaatgggtgagcccgcattattctcggaatccaactccacaaggtggtaggctccaagacgtctggcaagaagcatatgctagagcaaaagccatcgttggccagatgactattgttgaaaaggtcaatttgaccactggtaccggttggcaattagatccatgtgttggtaataccggttctgttccaagattcggcatcccaaacctttgcctacaagatgggccattgggtgttcgattcgctgactttgttactggctatccatccggtcttgctactggtgcaacgttcaataaggatttgtttcttcaaagaggtcaagctctcggtcatgagttcaacagcaaaggtgtacatattgcgttgggccctgctgttggcccacttggtgtcaaagccagaggtggcagaaatttcgaagcctttggttccgacccatatctccaaggtactgctgctgctgcaaccatcaaaggtctccaagagaataatgttatggcttgtgtcaagcactttattggtaacgaacaagaaaagtacagacagccagatgacataaaccctgccaccaaccaaactactaaagaagctattagtgccaacattccagacagagccatgcatgagttgtacttgtggccatttgccgattcggttcgagcaggtgttggttctgttatgtgctcttataacagagtcaacaacacttacgcttgcgaaaactcttacatgatgaaccacttgcttaaagaagagttgggttttcaaggctttgttgtttcggactggggtgcacaattaagtggggtttatagcgctatctcgggcttagatatgtctatgcctggtgaagtgtatgggggatggaacaccggcacgtctttctggggtcaaaacttgacgaaagctatttacaatgagactgttccgattgaaagattagatgatatggcaaccaggatcttggctgctttgtatgctaccaatagtttcccaacagaagatcaccttccaaatttttcttcatggacaacgaaagaatatggcaataaatattatgctgacaacactaccgagattgtcaaagtcaactaccatgtggacccatcaaatgactttacggaggacacagctttgaaggttgctgaggaatctattgtgcttttaaaaaatgaaaacaacactttgccaatttctcccgaaaaggctaaaagattactattgtcgggtattgctgcaggccctgatccgataggttatcagtgtgaagatcaatcttgcacaaatggcgctttgtttcaaggttggggttctggcagtgttggttctccaaaatatcaagtcactccatttgaggaaatttcttatcttgcaagaaaaaacaagatgcaatttgattatattcgggagtcttacgacttagctcaagttactaaagtagcttccgatgctcatttgtctatagttgttgtctctgctgcaagcggtgagggttatataaccgttgacggtaaccaaggtgacagaagaaatctcactttgtggaacaacggtgataaattgattgaaacagttgctgaaaactgtgccaatactgttgttgttgttacttctactggtcaaattaattttgaaggctttgctgatcacccaaatgttaccgcaattgtctgggccggcccattaggtgacagatccgggactgctatcgccaatattctttttggtaaagcgaacccatcaggtcatcttccattcactattgctaagactgacgatgattacattccaattgaaacctacagtccatcgagtggtgaacctgaagacaaccacttggttgaaaatgacttgcttgttgactatagatattttgaagagaagaatattgagccaagatacgcatttggttatggcttgtcttacaatgagtatgaagttagcaatgcaaaggtctcggcagccaaaaaagttgatgaggagttgcctgaaccagctacctacttatcggagtttagctatcaaaatgcaaaagacagcaaaaatccaagtgatgcttttgctccaacagatttaaacagagttaatgagtacctttatccatatttagatagcaatgttaccttaaaagacggaaactatgagtatcccgatggctacagcactgagcaaagaacaacacctatccaacctgggggcggcttgggaggcaacgatgctttgtgggaggtcgcttataaagttgaagtggacgttcaaaacttgggtaactccactgataagtttgttccacagttgtatttgaaacaccctgaggatggcaagtttgaaacccctattcaattgagagggtttgaaaaggttgagttgtccccgggtgagaagaagacagttgagtttgagcttttgagaagagatcttagtgtgtgggataccaccagacagtcttggatcgttgaatctggtacttatgaggccttaattggtgttgctgttaatgatatcaagacatctgtcctgtttactatttgaggcgcgccattgaattgaattgaaatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgtttcgaaagggctcttcattgagcttagaacccttttgggcagaaagatatccgtcgaacaacgttctattaggaatggcggataaattatttaaattatatcacactaattttcctcctgtggtagccctaagaacttttggtttgaatctgacgaataagatcggtccagttaagaatatgatcattgacacattaggaggaaatgagaaatgagaggtatgtaaatagaaatagactagctccacttttaagaattatttatgcaattaaatacatgggtgaccaaaagagcgggcggatacacgcgtcaccacaagcagaataaaaggtaaacctgaaattgttttaacataaaatgaaaaatgcttgtttgcaaccctatatagaatcataaaacattcgtgactataaaatgaataaactaaactattctaagaaaatgaaataaatgacaaaaaaacgtgttttttggactagaaggcttaatcaaaagctctcgagggcgcgcctacaaacattgagagtagtatgggtttaaaacttgacaggtagtaccagaagcacagacggttggaccagagtaaccgataccaccacattgaccgtagtgggattgggttgggcctggggaagaaccagttgtagtagctggcctacgagtagtggtagtacctctgttaccacctggagggttagaagcagtgaaagtggagttgattggaccgaatttaatgttggagtaagtgacgtaggagtttggagattgggattcgacgtcagatggaacaccagagtcagttggacaggtacctctagcgataccaggggtggttgggtcggcatcggttgggtaatcggagtccaaccacaacatttgagcagcgtagtcgtcccacaaagacatgaccaaaaccataccttgttgcatagcagcacccatcttagccaaaccaccgtgttgagagaagtcgtcggtgtcaccgaaagcttgcttttgggcggtacaaaattcggtggtaatggagttaccagtgacaccagagatgtcggaatttggttgtgggatgacgttagagttttggatgtagaatctcttgatttcggacaaagtaccggtatcagtaccatcgtcggtcaagaattgggtgacaacagtgaatggcttagtagtgtcgatgatcttgcctggaccgtaaaaggaagtgttacccattctgtatggattgaagtcgcaaccgtctggatcacaggtaccagcgtatctatcgttagagtaagtaccaccacagtcatcgccggaacacatagtttgacctggagtgtcacatgggtgtggagtgacggcgttggaaatggagttggcttcccaaacgtccatttcggcacagcaagaaccgtggtcaccgatgccagtgttagcgttgttagaagatggttgccaaccttcgacattagcttcaccatcaataaacttcaagtcacgtggacattgagagtcacagtaaccagtaccgtatttggcaccagccttgttgtttgggtacttggaaacaccaccatcagcgtccatagcaacgaagtatagagcaccgttcaaaccacaaggcaagttggacacatcgacgtcgaaagaaaattctctgttcaacaacttgaagatttggtaagtggagtcatcttgcaacaaatacaatctggaaccgacgttagaaccagtgacgaagttcaacttcaaggaagaaccagaggaggtaacaccgtaagtaccttcgtagtcagcaccgtccaaggcacagttttgagcgcaagtttcgtcgtctggacagtaagttgggtcccaggtgttaccggtgtaacagttagtgtaaccgttgacgtcgtggacccatctccagttagcgtccaagacgacagcaccgttttgggtggtacaagaacctggagcggtacattcttgccaggtcaatggagggtggttttcagcagtagcggtaccggcttgttgagccttaacggccaagatagcagaagagctcaatagtaaagctcttcttagcatgaattctttgatttagtgtttgtgtgttgataagcagttgcttggttttttatgaaaaatagctagaaggaataagggattacaagagagatgttacaagaaagaagtaaaataaatttgattaatattgccattatcaaaagctatttatatgttgaaatcgtggagatcatgtgtgccagaaaaggccacagtttccggggagaggcataccttgaggtggctaggaatcacggagacctcttgacttgcagggtaggctagctagaattaagtgaggtgacaaggtttccatacagttttgaccttgagacgttgctacttacgatttgcagtatgcaagtctcatgctgcaaacaaaagaggaccgctcaggtaatcgctcaattagtggacgttatcaggggcgggagaggcgaaagtggtttttggtggtgtaagtaaaggtcgtccaaatatgcaggtgtttgggtgctatcctagtggaagctcggatcagtagataacccgcctagaagtttaaacataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacatatatctcaccgcggccgcgctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 519 - DNA, 1329 bp, Parabacteroides distasonis XI xylose isomerase
atgagttactttaaaggagagaaagaatttttcccgggaatcggacaaattcagtttgagggacgtgagtcaaaaaatccgttggcatttcattattatgacgcggataaggtagtaatgggtaagacactaaaggatcatttacgcttcgctatggcttattggcataccttatgtgctgagggaggtgatcagtttggtggtggaacgaagacattcccttggaacgacagcacggacgctatcacccgcgcgaagtacaagatggacgccgctttcgagtttatgaccaaatgtaatattccttactattgcttccacgacgtggacgtggtggacgaggctcctacgctgggcgagttcgagaaacgtttgcagacgatggtggaacatgccaaggagcatcaagccgctaccggaaagaaactgctatggtctaccgctaacgtgttcggacataagcgttatatgaacggtgccgctacgaacccttatttcccgaccgtggcatgcgtcggcacgcagatcaagaacgctattgacgcttgtatcgccttagggggcgagaactacgtgttctggggcggccgtgaggggtatatgagcctattgaatacgaacatgaaacgtgagaaggatcatttagccatgatgttgacgatggcccgtgattatggccgcaagaacggtttcaagggtacgttcctgatcgagccgaaaccgatggaaccgacgaaacatcaatatgacgtggattcggagaccgtgatcggcttccttcgccattatggattggacaaggatttcgccttgaatatcgaggtgaaccacgctaccttggccggacatacattcgagcatgaattgcaagccgccgccgacgccggcatgttgtgcagtatcgacgcgaaccgtggcgattaccagaatggttgggatacggatcaattcccgatggatatctatgagctggcacaggcttggctggttatccttgagggaggtggcttgactaccggaggtacgaacttcgacgccaagacccgccgtaattctacggacttggaggatatcttcatcgctcatatcggtggtatggacgctttcgcccgtgccttgatgatcgccgccgatatccttgagaactcagactaccgcaagatgcgtgccgagcgttacgctagtttcgatgccggcgagggcaaggcattcgaggatggcaagcttacgctggaagatcttcgtacgatcgctttgcgtgacggcgagccgaaacagatcagcggtaagcaggaattatacgagatgattgtaaatctgcatatctaa

SEQ ID NO: 520 - DNA, 1329 bp, Chitinophaga pinensis XI xylose isomerase
atgagtattactttagggaatcaggagtacttcaaaggcattggtaaaatcgcctatgaaggacctcagtcaacaaatccgtttgcctacaaatggtatgacgagaacagaaagatcggtggtaaaaccatgaaggaactgtttcgttttgcagtctcctactggcacaccttctgtggtaccggcggagatccgttcggtccgggcaccaaggctttcccctggttaactgccactgatgcagtgcagagtgcgaaagataaaatggatgctgcattcgaattcttcaccaaactgggtgttccttactactgcttccacgatgtggatctggtagatgaaggcgcatcgatcagcgagtacgaaagccgtatgcagcagatcgtggagtatgcaaaagaaaaacaaaaagccagcggtgtaaaactgctgtggggtactgcgaatgtgttcagcaatccgcgttacatgaatggtgctgctaccaatccggacttcgctgctgttgcctatgcaggtacccaggtgaaaaactccctggatgcaacgatcgcactgggtggtgaaaactacgtattctggggcggccgtgaaggttacatgaccctcctgaacaccgacatgaagcgtgaacaggaacacctggcccgcttcctgacaatggcaaaagattacgcgcgtaaacagggctttacaggtaccttcttcatcgaacctaagccttgcgaacctaccaaacatcagtacgattatgatgctgcgaccgtaatcggcttcctgcgtcatttcggactggataaagacttcaaattgaacctggaggtaaaccacgcaaccctggcaggtcataccttccagcacgaactgcaggttgctgccgatgcaggtatgctgggcagtatcgacgcaaaccgtggtgatgcacagaacggctgggatactgaccagttcccgatgaacctgaacgacatggttgagttcatgctggtgatcctggaagctggcggcttctccggcggtggtgtgaacttcgatgcgaaaacacgccgtaactcaactgacctggaagacatcttccatgcacatatcggtggtattgattcctttgcacgtgccgccgttatcgcagaaaaagtgctggaacagtctccatacaaacagttccgcaaagaccgttacgcttcattcgacagcggtaagggtaaagatttcgaagctggtaccctgacactggaagatctgcgcagctttgccgtaagcaatggcgagcctaagcatatcagcggtaaacaggaatggctggagaatatcatcaatcagtatatctga

SEQ ID NO: 521 - DNA, 1530 bp, Bacteroides thetaiotamicron araA
atgaataacgtatttgatcagtatgaagtatggttcgtaacaggagcacagctcttgtacggaggtgatgcagtaatcgcagtagacgcacactctaacgaaatggttaacggtctgaatgaatcgggcaaacttcctgttaaagtagtatacaaaggaacggccaactcttctaaagaggtggaagctgtattcaaagcagccaacaacgatgacaaatgtgtaggcgtcatcacttggatgcatactttctctcctgctaaaatgtggattcatggtctgcaacaattaaagaaaccattgctgcacctgcatactcaattcaacaaggaaattccttgggatacaatggatatggactttatgaatctgaaccagtcagctcacggcgaccgcgagttcggacatatctgtacccgtatgcgcatccgtcgcaaagtagtggtaggctactggaaagaagaagaaacattgcataagattgctgtctggatgcgtgtttgcgcaggttgggcagactctcaggatatgctgatcatccgtttcggcgatcagatgaataatgtagccgtaaccgatggtgacaaggtagaagcagaacaacgcatgggctatcatgtagattattgcccggcaagcgagctgatggaatatcacaaagatatcaaaaatgctgatgtagatgctttggtagctacttacttcaatgactacgatcatgacgcttctctggaagacaaatcaaccgaagcttatcagaaagtatggaatgctgccaaagccgagcttgctctccgtgctatcctcaaagcgaaaggcgccaaaggattcactaccaactttgacgatctgggtcagactgacggtagctatttcgatcagattccgggactggcttctcaacgcctgatggcagaaggctacggattcggtgctgaaggtgactggaaatcggctgctctttatcgtactgtatgggtaatgaatcaaggacttccgaaaggctgttcattcctcgaagactatacactgaactttgatggtgccaacagttctatcctacagtcacatatgttggagatctgtccgcttatcgcagctaacaagcctcgtctggaagtacacttcctcggcataggtatccgtaagagccagactgcccgtcttgtgttcacttcaaagacaggaacaggctgcaccgcaactgtagtggatatgggtaaccgtttccgtctgatcgtaaacgatgtagaatgtatcgaaccgaaaccacttccgaaattgccggttgcttccgcactctggattccgatgcctaacctcgaagtaggcgcaggcgcatggattctggccggtggaactcaccactcttgcttctcatacgacttgacagcagaatactgggaagattatgcagaaatcgcaggcatcgaaatggtacatatcaataaagatacgactatcagctgcttcaagaaagaactgcgcatgaatgaagtatattatatgctgaacaaagcgctttgctaa

SEQ ID NO: 522 - DNA, 1592 bp, Bacteroides thetaiotamicron araB ribulokinase
atgaaattagatgcaaaatcaaccatcgagacaggtaaagctatccttggcatagaactcggttctacacgaataaaagctgttctgattgaccaggaaaacaaacctatcgctcaaggcagccacacatgggaaaatcaactggtcaacggactttggacttacagcattgatgccatctggtccggactgcaagattgctacgccgacctccgctccaacgtgaagaaattatacgacacagagatcgaaacactggcagccatcggtgtcagcgccatgatgcatggttacatgcctttcaatgaaaaagaagaaatcctcgtgcctttccgcacttggagaaataccaatacaggccgtgctgcggcagaattatccgaattatttgtctataacatccctttgagatggagcatttctcatttgtaccaggctattctggacaacgaagcgcacgtcaaagacatcaagttcctgacaactcttgcaggttatgtacattggcagataacaggcgaaaaggtgttgggcattggtgacgcatcgggtatgctccccatagatccgactaccaacaactattccgccgaaatggtggccaaattcaacaatctgattgcttcgaaagaatacagttggaaactggaagacattctgcccaaagtattgtcggctggtgaaaatgccggtgtcctcacaccggaaggctgtaaaaaactcgatgcatccggtcatctgaaggcaggaataccggtctgcccaccggaaggagacgcaggcaccggcatggtagcaaccaacgccgtcaagcaacgcaccggcaacgtatcggcaggtacttcttctttctctatgatcgtattggaaaaagaattgtcgaagccatacgaaatgatcgacatggtcaccactcccgacggaagcctcgtagccatggtacattgcaacaactgtacttcggatcttaacgcatgggtcaacctgttcaaagaataccaggaacttctgggtatacctgtagatatggatgaactctatggcaaactttataacattgcccttaccggtgataccgattgcggtggtctcctctcctacaactacatttcaggcgaacctgttacgggacttgccgagggaagacctttgttcgtacgttcggccaatgacaagttcaaccttgcaaactttatgcgggctcatttgtacgcctcagtcggagttctcaagattggcaacgacatcttgttcaacgaagaaaagatcaaagtcgacagaatcacaggtcacggaggattgttcagaaccaaaggagtcggtcaaagagtacttgcagcagccatcaactcgcccatatctgttatggaaacagccggtgaaggcggtgcatggggaattgccctgctgggttcttacctggtaaacaataaaaagggtcaatctcttgccgatttcctggatgaaagtgtatttgtcagcgatgctggtgtcgaggtatcacccacacccgaagatgtagccggcttcaacacatacatcgaaagctacaaggcaggtttgcctatagaagaagcagccgtcaaattcaa

SEQ ID NO: 523 - DNA, 684 bp, Bacteroides thetaiotamicron araD ribulose-5-phosphate 4-epimerase
atgctggaagaactgaaagaaaaagtatttcatgccaatctcgaattggtaaagcatggattagtcatctttacatggggaaatgtttctgccatcgaccgtgaaacggaactggtagtcatcaaacccagtggagtcagttatgatgatatgaaagcggaagatatggtagtagtggacctggatggcaaagtcgtcgaaggacggctgaagccatcctcagatactcctactcacgtggtactctacaaagcattccccgaaatcggcggagtggtgcatacccactctacttatgctaccgcatgggcgcaggccggttgtgatattcccaatatcgggacaactcacgctgactatttccatgatgcaatcccctgcacagcggatatgacggaagctgaagtaaaaggtgcctatgaactggaaaccggaaacgtgatcgtaaaacgtttcgaaggcctgaaccctgtacatacaccgggagtattggtcaagaatcatggtcctttctcttggggaaaagacgcacacgatgccgtacacaatgcagtagtgatggaacaagttgccaaaatggcaagcattgcttatgccgtgaatcccaatttaacaatgaacccgctgctggtagagaaacacttcagccgcaagcatggtccgaacgcttactacggacaataa

SEQ ID NO: 524 - protein, 885 aa, Piromyces sp. adhE; identical to SEQ ID NO: 472

SEQ ID NO: 525 - DNA, 2658 bp, Piromyces sp. adhE; identical to SEQ ID NO: 491

SEQ ID NO: 526 - DNA, 59 bp, Artificial
  Primer X10821
aagagggtggtgttcctattggcggatgtcttatcaataacaaagacggaagtgttctc

SEQ ID NO: 527 - DNA, 59 bp, Artificial
  Primer X10824
ttttgaaattaacgttctcaccgacaacacagcgtggaataccatacatgatgatggca

SEQ ID NO: 528 - DNA, 39 bp, Artificial
  Primer X11631
ttgccaaagtggattctcctactcaagctttgcaaacat

SEQ ID NO: 529 - DNA, 59 bp, Artificial
  Primer X12837
gaagctcggatcagtagataacccgcctagaagactagtagctatgaaatttttaactc

SEQ ID NO: 530 - DNA, 58 bp, Artificial
  Primer X12838
gagagccagcttaaagagttaaaaatttcatagctactagtcttctaggcgggttatc

SEQ ID NO: 531 - DNA, 59 bp, Artificial
  Primer X12822
gttttttccccgtcagcgatggtgacgtaaacgactagatttaggacactaattgaatc

SEQ ID NO: 532 - DNA, 59 bp, Artificial
  Primer X12823
aaaaaatgacgcgggcagattcaattagtgtcctaaatctagtcgtttacgtcaccatc

SEQ ID NO: 533 - DNA, 58 bp, Artificial
  Primer X12824
gatgggttcctagatataatctcgaagggaataagtaggcaaagaggtttagacattg

SEQ ID NO: 534 - DNA, 59 bp, Artificial
  Primer X12825
gttctaagctcaatgaagagccaatgtctaaacctctttgcctacttattcccttcgag

SEQ ID NO: 535 - DNA, 58 bp, Artificial
  Primer X12826
gtttattacatgaagaagaagttagtttctgccttgcttgctagagaataaattcaag

SEQ ID NO: 536 - DNA, 57 bp, Artificial
  Primer X12827
gttcaacatcatcttttaacttgaatttattctctagcaagcaaggcagaaactaac

SEQ ID NO: 537 - DNA, 59 bp, Artificial
  Primer X12828
cgggtgacccggcggggacgaggcaagctaaacagatctcaaacaacttaaaatcagtc

SEQ ID NO: 538 - DNA, 59 bp, Artificial
  Primer X12829
ggcatatcaagaccctgcctggactgattttaagttgtttgagatctgtttagcttgcc

SEQ ID NO: 539 - DNA, 58 bp, Artificial
  Primer X12841
atataaaattaaatacgtaaatacagcgtgctgcgtgctattaagggttctcgagagc

SEQ ID NO: 540 - DNA, 59 bp, Artificial
  Primer X12842
ccagtgtcgaaaacgagctctcgagaacccttaatagcacgcagcacgctgtatttacg

SEQ ID NO: 541 - DNA, 33 bp, Artificial
  Primer X11634
tagcccttggttgagcttgagcgacgttgaggt

SEQ ID NO: 542 - DNA, 23 bp, Artificial
  Primer X12427
ggccgctgttggaataaaaatcc

SEQ ID NO: 543 - DNA, 87 bp, Artificial
  Primer X13008
ctcggatcagtagataacccgcctagaagactagtggatcgatccccgggatgtttatattcattgatcctattacattatcaatcc

SEQ ID NO: 544 - DNA, 69 bp, Artificial
  Primer X13009
atctgtaccaagttgaacgactggtactctcaatgtttataaggcgcgccacaggccccttttcctttg

SEQ ID NO: 545 - DNA, 50 bp, Artificial
  Primer X13010
ccgccatccagtgtcgaaaacgagctcgtcgacaactaaactggaatgtg

SEQ ID NO: 546 - DNA, 50 bp, Artificial
  Primer X13011
cctcacattccagtttagttgtcgacgagctcgttttcgacactggatgg

SEQ ID NO: 547 - DNA, 77 bp, Artificial
  Primer X13012
gctgttaatgatatcaagacatctgtcctgtttactatttgaggcgcgcctcagtactgacaataaaaagattcttg

SEQ ID NO: 548 - DNA, 73 bp, Artificial
  Primer X13013
gcgacgccggcgaggagggaggtgaaggagacattttgtttttaattaaggttgtttatgttcggatgtgatg

SEQ ID NO: 549 - DNA, 50 bp, Artificial
  Primer X13014
ttgttgttccctcacattccagtttagttgtcgacagcttgccttgtccc

SEQ ID NO: 550 - DNA, 50 bp, Artificial
  Primer X13015
ggtgacccggcggggacaaggcaagctgtcgacaactaaactggaatgtg

SEQ ID NO: 551 - DNA, 24 bp, Artificial
  Primer X13016
gctcaattagtggacgttatcagg

SEQ ID NO: 552 - DNA, 23 bp, Artificial
  Primer X12434
ccgcggtgagatatatgtgggta

SEQ ID NO: 553 - DNA, 310 bp, Saccharomycopsis fibuligera BGL1
atggtctccttcacctccctcctcgccggcgtcgccgccatctcgggcgtcttggccgctcccgccgccgaggtcgaatccgtggctgtggagaagcgctcgcgagtcccaattcaaaactatacccagtctccatcccagagagatgagagctcccaatgggtgagcccgcattattatccaactccacaaggtggtaggctccaagacgtctggcaagaagcatatgctagagcaaaagccatcgttggccagatgactattgttgaaaaggtcaatttgaccactggtaccggttggcaattagatc

SEQ ID NO: 554 - DNA, 255 bp, Kluyveromyces lactis araT
atgtcattgaaaaattggcttttgctacgtgatatccaatacgagggaacgttttataaaaagttcccccatgtctacaacatttacgtcatcggtttcatagcatgtatctccggtcttatgttcggttttgatatcgcatcgatgtcttctatgattggtaccgatgtttacaaggactatttcagtaatcctgactctttgacttacggtggtattactgcttctatggcaggtggttcattcttgggttct

SEQ ID NO: 555 - DNA, 1669 bp, Piromyces sp. XI xylose isomerase
gtaaatggctaaggaatatttcccacaaattcaaaagattaagttcgaaggtaaggattctaagaatccattagccttccactactacgatgctgaaaaggaagtcatgggtaagaaaatgaaggattggttacgtttcgccatggcctggtggcacactctttgcgccgaaggtgctgaccaattcggtggaggtacaaagtctttcccatggaacgaaggtactgatgctattgaaattgccaagcaaaaggttgatgctggtttcgaaatcatgcaaaagcttggtattccatactactgtttccacgatgttgatcttgtttccgaaggtaactctattgaagaatacgaatccaaccttaaggctgtcgttgcttacctcaaggaaaagcaaaaggaaaccggtattaagcttctctggagtactgctaacgtcttcggtcacaagcgttacatgaacggtgcctccactaacccagactttgatgttgtcgcccgtgctattgttcaaattaagaacgccatagacgccggtattgaacttggtgctgaaaactacgtcttctggggtggtcgtgaaggttacatgagtctccttaacactgaccaaaagcgtgaaaaggaacacatggccactatgcttaccatggctcgtgactacgctcgttccaagggattcaagggtactttcctcattgaaccaaagccaatggaaccaaccaagcaccaatacgatgttgacactgaaaccgctattggtttccttaaggcccacaacttagacaaggacttcaaggtcaacattgaagttaaccacgctactcttgctggtcacactttcgaacacgaacttgcctgtgctgttgatgctggtatgctcggttccattgatgctaaccgtggtgactaccaaaacggttgggatactgatcaattcccaattgatcaatacgaactcgtccaagcttggatggaaatcatccgtggtggtggtttcgttactggtggtaccaacttcgatgccaagactcgtcgtaactctactgacctcgaagacatcatcattgcccacgtttctggtatggatgctatggctcgtgctcttgaaaacgctgccaagctcctccaagaatctccatacaccaagatgaagaaggaacgttacgcttccttcgacagtggtattggtaaggactttgaagatggtaagctcaccctcgaacaagtttacgaatacggtaagaagaacggtgaaccaaagcaaacttctggtaagcaagaactctacgaagctattgttgccatgtaccaataagttaatcgtagttaaattggtaaaataattgtaaaatcaataaacttgtcaatcctccaatcaagtttaaaagatcctatctctgtactaattaaatatagtacaaaaaaaaatgtataaacaaaaaaaagtctaaaagacggaagaatttaatttagggaaaaaataaaaataataataaacaatagataaatcctttatattaggaaaatgtcccattgtattattttcatttctactaaaaaagaaagtaaataaaacacaagaggaaattttcccttttttttttttttgtaataaattttatgcaaatataaatataaataaaataataaaaaaaaaaaaaaaaaa

We claim:

1. A recombinant yeast host cell comprising
a heterologous polynucleotide encoding a polypeptide comprising an amino acid sequence at least 90% identical to the amino acid sequence of SEQ ID NO: 445;
wherein the recombinant yeast host cell expresses the polypeptide;
wherein the recombinant yeast host cell produces at least about 0.5 g of ethanol per hour per liter at 32.degree. C. on a substrate of corn mash, corn flour or a combination thereof; and
wherein the recombinant yeast host cell is capable of producing ethanol at a rate at least equivalent to an otherwise identical yeast host cell not expressing a polypeptide at least 90% identical to SEQ ID NO: 445 when the otherwise identical host cell is provided 0.3 AGU/g solids of exogenous glucoamylase.

2. The recombinant yeast host cell of claim 1, wherein the heterologous polynucleotide encodes a polypeptide comprising an amino acid sequence at least 95% identical to the amino acid sequence of SEQ ID NO: 445.

3. The recombinant yeast host cell of claim 2, wherein the heterologous polynucleotide encodes a polypeptide comprising the amino acid sequence of SEQ ID NO: 445.

4. The recombinant yeast host cell of claim 1, wherein the yeast strain is a *Saccharomyces cerevisiae* strain.

5. The recombinant yeast host cell of claim 1, further comprising one or more additional heterologous polynucleotides encoding one or more additional polypeptides comprising an amino acid sequence at least 90% identical to an amino acid sequence selected from the group consisting of SEQ ID NO: 443, SEQ ID NO: 287, SEQ ID NO: 450, SEQ ID NO: 451, and SEQ ID NO: 452.

6. The recombinant yeast host cell of claim 5, wherein the one or more additional heterologous polynucleotides encoding one or more additional polypeptides comprises an amino acid sequence at least 95% identical to an amino acid sequence selected from the group consisting of: SEQ ID NO: 443, SEQ ID NO: 287, SEQ ID NO: 450, SEQ ID NO: 451, and SEQ ID NO: 452.

7. The recombinant yeast host cell of claim 6, wherein the one or more additional heterologous polynucleotides encoding one or more additional polypeptides comprises an amino acid sequence selected from the group consisting of: SEQ ID NO: 443, SEQ ID NO: 287, SEQ ID NO: 450, SEQ ID NO: 451, and SEQ ID NO: 452.

8. The recombinant yeast host cell of claim 5, wherein the yeast strain is a *Saccharomyces cerevisiae* strain.

9. The recombinant yeast host cell of claim 1, wherein the host cell further expresses a xylose isomerase.

10. The recombinant yeast host cell of claim 9, wherein the host cell is capable of fermenting a pentose sugar.

11. The recombinant yeast host cell of claim 10, wherein the pentose sugar is xylose or arabinose.

12. The recombinant yeast host cell of claim 9, wherein the xylose isomerase is isolated from an organism selected from the group consisting of: *Piromyces, Bacterioides thetaiotaomicron, Chitinophaga pinensis, Parabacteroides distasonis*, and combinations thereof.

13. The recombinant yeast host cell of claim 1, further comprising one or more additional heterologous polynucleotides encoding one or more additional polypeptides comprising an amino acid sequence at least 90% identical to an amino acid sequence selected from the group consisting of: SEQ ID NO: 453, SEQ ID NO: 454, SEQ ID NO: 455, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, and SEQ ID NO: 465.

14. The recombinant yeast host cell of claim 13, further comprising one or more additional heterologous polynucleotides encoding one or more additional polypeptides comprising an amino acid sequence at least 95% identical to an amino acid sequence selected from the group consisting of: SEQ ID NO: 453, SEQ ID NO: 454, SEQ ID NO: 455, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, and SEQ ID NO: 465.

15. The recombinant yeast host cell of claim 14, further comprising one or more additional heterologous polynucleotides encoding one or more additional polypeptides comprising an amino acid sequence selected from the group consisting of: SEQ ID NO: 453, SEQ ID NO: 454, SEQ ID NO: 455, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, and SEQ ID NO: 465.

16. The recombinant yeast host cell of claim 13, wherein the yeast strain is a *Saccharomyces cerevisiae* strain.

17. The recombinant yeast host cell of claim 1, further comprising one or more additional heterologous polynucleotides encoding one or more additional polypeptides comprising an amino acid sequence at least 90% identical to the amino acid sequence of a polypeptide selected from the group consisting of: SEQ ID NO: 447, SEQ ID NO: 448, and SEQ ID NO: 449.

18. The recombinant yeast host cell of claim 1, wherein the quantity of ethanol that is produced at 35.degree. C. on a substrate of corn mash, corn flour or combinations thereof is at least about 125 grams per liter in 72 hours.

19. The recombinant yeast host cell of claim 1, wherein the quantity of ethanol that is produced at 35.degree. C. on a substrate of corn flour is at least about 1.9 grams per liter per hour.

20. The recombinant yeast host cell of claim 1, wherein the quantity of ethanol that is produced at 35.degree. C. on a substrate of corn mash is at least about 2.2 grams per liter per hour.

21. The recombinant yeast host cell of claim 1, where the ethanol is produced at a temperature of at least about 35.degree. C.

22. The recombinant yeast host cell of claim 17, comprising one or more copies of each of the heterologous polynucleotides encoding the polypeptides comprising amino acid sequences at least 90% identical to the amino acid sequences of the polypeptides encoded by: SEQ ID NO: 447, SEQ ID NO: 448, and SEQ ID NO: 449.

23. The recombinant host cell of claim 17, comprising four or more copies of the heterologous polynucleotide encoding a polypeptide comprising an amino acid sequence at least 90% identical to the amino acid sequence of SEQ ID NO: 445 and one or more copies of each of the heterologous polynucleotides encoding the polypeptides comprising amino acid sequences at least 90% identical to the amino acid sequences of the polypeptides encoded by: SEQ ID NO: 447, SEQ ID NO: 448, and SEQ ID NO: 449.

24. The recombinant yeast host cell of claim 17, further comprising a down-regulation of at least one gene encoding an endogenous glycerol-producing enzyme selected from the group consisting of: glycerol 3-phosphate dehydrogenase 1 and glycerol-3 phosphate dehydrogenase 2.

25. The recombinant host cell of claim 1, comprising two or more copies of the heterologous polynucleotide encoding a polypeptide comprising an amino acid sequence at least 90% identical to the amino acid sequence of SEQ ID NO: 445.

26. The recombinant host cell of claim 1, comprising four or more copies of the heterologous polynucleotide encoding a polypeptide comprising an amino acid sequence at least 90% identical to the amino acid sequence of SEQ ID NO: 445.

27. A method of producing ethanol comprising: (a) providing the host cell of claim 1; and (b) culturing said host cell in the presence of a substrate selected from the group consisting of: corn mash, corn flour, and combinations thereof for sufficient time to produce ethanol.

28. The method of claim 27, wherein the host cell is cultured at about 35.degree. C.

* * * * *